United States Patent 10,407,724 (METHODS AND COMPOSITIONS FOR SCREENING AND TREATING DEVELOPMENTAL DISORDERS) - sequence listing, part 48

SEQ ID NO: 1081 - DNA, 102488 bp, Homo sapiens
tagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccaggtattaaacccagtactcattagttacgttttctgctcctctccctcctcccaccctctacccaccagccccagttgtttttttctttgtgttcataagttcttactatttagctctcacgtagaaatgaagacatgcaatatatggttttcttttcctgtgtgtgtttgctaaggataaaagcctccacctccatccatgttcctgcaaaagacatgatcttattttttatggctgcatagtattccatgatatatatataccatattttctttatccagtctgtcattgatgggtatatagggtgattccatgtcttggctatagtgaatagtgctacagtgaacagtgctacagtgaacatttacgtgcatgtgtctttatggtggaataatttatgttccttggggtatatattcagtaatgggattgctgggatgaatggtagttttgcttttagctctttgaggaatcaccatagtgcttccacgattgttgaactaatttacactcccaccaaaagtgtataaatgttcccttttgtccacaacctcaccagtatgttattttttgactttttattaatagccattctgactgatgggagatgataatctccttgtggttttgatttgcatttctctaatgatcagtgctactgagctttcttatgtgcttgttggcagcatgtatgtatgtcttcttttgagaagtgtctgttcatgtcctttgcccactttttaatggggtggtttttctcttgtaaatttgttcaagttcctcatagatgccggatattagacctttgttggatgtatagtttgcacatattttctcctgttctgtaggctgtttggttttttttgctgtgcagaagctcttaagtttaattagatctcatttgtcagttaatttttgcttttgttgcaattgcttggtgcctttgtcatgaaatctttgcccattcctatgtctgggatggtattgcctaggttgtcttccagggtttttaaagttttgggttttacatttaagtctttaatccatcttgagttgatttttatatatggtataaggaaagggtacagcttcaatcttctgcatatggctagccagtcattccagcatcatttattgaatagtgagtcttttccccattgcttgtttctttcagctttgttgaagatcagatggtcataggtgtgtggccttatttctgggttctctatactgttccattggtctatgtgcctgtttttataccactgtcatgcagttttagttcctgtagtcctgtagtatagtttgaagtgggttcatgtgatgcctccagctttgttctttttgcttaggattgccctggctattcaggcccttttttggttccatatgaattttaaaatagttttatctagttctgtgaagaatgtcattggtagttttataggaatagcattgaatctgtaaattgctttagccaatatggccattttaatgataacgattcttcctatccatgagcatggaatgttttttcatttgtttgtgtcttctctgatttatttaagcagtgttttataattctcattgtagaaatctttcacctccctggttagctgtattcctaggtattttattctttttgtggcaattgtgaatgggattgtctgatttggctctcagtttggttattggtggtgtataggaatgctagtaatttttgtacattgattttatatcctgaaactttgctgaagttatcagctcaaggagcttttgggtggagaccattctagatatagaatcatgtcatctgcaaacagagatagtttgacttcctctcttcctatttggatgtcctttctttctttctcttgcctgactgctctggctaggatttccaatactatgttgaataggagtggtgagagagggtatcctcgtcttaacgccagttttcaagggaaatgcttccaggttttatctattcagtataatgttggccatgagtttgtcatggatgcctcttattattttgaggtatgttcctacaatacctagtttgttgagagtttttaacatgaagcagtgttgaattttttttttttttaagtctttttctttttttttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtatctgttcatgtccttcgcccactttttgatggggttgtttgtttttttcttgtaaatttgtttgagttcattgtagattctggatattagccctttgtcagatgagtaggttgcaaaaattttctcccattttataggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggaggttttgggctgagacgatggggttttctagataaacaatcatgtcgtctgcaaacagggacaatttgacttcctcttttcctaattgaataccctttatttccttctcctgcctgactgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcagctgtgaatccatctggtcctggactctttttggttggtaaactattgattattgccacaatttcagagcttgttattggtctattcagagattcaacttcttcctggtttagtcttgggagagtgtatgtgtcgaggaatgtatccatttcttctagattttctagtttatttgcgtagaggtgtttgtagtattctctcatggtagtttgtatttctgtgggatcggtggtgatatcccctttatcattttttattgtgtctatttgattcttctctctttttttctttattagtcttgctagcggtctatcaattttgttgatactttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcgtttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgttgggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgacctgcttcggctcgcgcacggtgcgcgcacacactggcctgcgcccactgtctggcactccctagtgagaagaacccggtacctcagatggaaatgcagaaatcacccgtcttctgcgtcgctcacgctgggagctgtagaccggagctgttcctattcggccatcttggctcctcccccaagtgttgaattttatcagaagccttttctgcacctattgagatgatcatgtggtttttgtctttagttctgtttatgtgatgaatcacatttattgatttgcatatgttgaaccaaccttgcatcccgtataagtgtacttgatcatggtggattaacttttaatgtgttgctggattcagtttgcaagtattttgttgaggatttttgcatcaatgttcatcaaagatattgacctgaagttttctttttttattgtgtctctgtcatgttttagtatcaaggtgatgctggcctcatagaatgagttaagaggagtccctcctcctcaatttttttggagtagtttctgtaggaatagtacctgctcgtctttgtacatttccactgatcattttactgtctccatagttttgtcttttccaaaatgtcatatagttgcaatcctatagtatgtagccttttcagactgccttatttcgtttagaaatatgcaattaagtttcttctatgtctttttgtggcttaatagctcctttctttgtagcactgaatagtattccattgtatggatgtaccacagtttgtttatccattcacctgttgaaagatctcttggttgcttccaagtctttgcaattacaaataaagctgctctaagcattcgtgtgcaggtttttttgttttgttttgttttgttttgttttgagacagagtcttactctgtcacctaggctggagtgcaatggtgtgatctcggctcactgtagcctccatctcccaggttctagcaattctcatgcctcagcctccccagtagctgggattacaggcacccaccactacgcctggctaattttttctatttttagtagagatggggttttaccatgttggccaggctggtcttgtactcctgacctcaggtgatccatccgcctcgacctcccaaagtgctgggcatgagccacgatgcccagcccctgtgtaggtttttatgtagacataatttgcagcttatttgagtaaataccatggagcacagttcctacactgtatggtaagaatgtatttagttttatgagaaattgccaaactaccttccaaaatggctgtaacattttatattccagagagcagtaaattagagtttctgttgtcttacatcctcaccagcatttggtggtgtcagtgttttagattttcaccattctaattggcatgtagtggtatctcgttgttttagtttgcagttccctaatatgatattgagcatcttttcatatgcatatttgccatctgtttattttctttggtaaagtatctgtttagctcaactctcttttgccttttttttttttaaatactgggtcttgctatgttgccccgactggatttaaattcctgggctcaagtgatcccagtgcctcagcatactgagtagctgggactgcaggcacataccaccatttgttaattgttttctcattgttgacttttaagcattctttttagattttatatttctggggttttgttttgtttttttgagacagagtctcacttccgtcacccaggctggagtgcagtggtataatctcggctcactgcaacctctacctcctgggttcaagcaattctagtgcctcagcctcctgcatagctggaattacaggcgcacgccaccacacccagctaatttttgtatttttagtagatagggtttcgccatgttggccaggctggtcgcaaactcctgacctcaagtgatctgcccgcctcagcctcccaaagtgctgagattacaggcatgagctaccatgcccagccaatttctgttctttatatgtgttttgcaaagatttttttttccccattttgtggcttgctgttttattctcttaacagtgtctttcaaagagcagaagtgtttaaatgttcttaaatatattgggtcaatcttttgtttgtttgttttaagaaatcagtgtattaaatttatatacaaaattgattcttagctatgttttaattttgttagcatcagtcactaataacaaaactgagattgttctacttggtagaatttagagggattttgccctccctctaaatcctatctaaaaacttttataactttcctcttctgttcattatgagatagacctgtgatgactgcctgtgtacttcaaagtcctttctctgagttttcttagttggtcactaaaacaggcaacattctacttggcagagacaaaatgttgatcatttctataatattttgtttggaggttataaatcattgcagcttctcattgacatggcttatttcaggttaggaaccagaacctagggctctcctcccatgaaattctactaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaactgagcttctcttttgagaagatcaagatatttagcaactggagaacagtgtagtgtaatggtaaaagaccaagctcttgggttagaaagacttggattcaagtctcagtgtaaggcacactacgtaacctctataagcctccatgttcacatctgtaaaatggagttaatgcctattatacagggtcatattgatagaattaaatgctctgtataaattaggtgcagaccaaaacagactcttttgatagattaaatgtttatcccctttgtccattcccttatctggaccaatgaaatgagtttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggccacagccagacatggcctcccatgtggcttcaggtcagccagagccagtcaatccgatatcctactactcgtaccctcttcttctgtttatgacattatggatccaaatacagataggtgtgcagctacttaaataagtctaactccagtaataccaaaataaccctaaatctgcaacagatgcaaggatgccccctgggggcaattgttaagtgtgatgacagctgggcatcaattaatacatttgtcacctgctcatgagataggatcatgggaggtttggcaaagggacagtctgttgaacactgcacaaaacttagtagcaagaaaaattatttgtgcaggtattcatttttattttactttaatgttctgccttatctagttgcctgttttgagtcacaactttctctgtgcatttagatgaggttaataagatggctggtgagagcagtgcccccttcagccaagattaccaaaaaaaaccttgttcaaatgcccctcagaatttttcctgggaaatatgggccttctcattatgggcttaatgttcataatttattaggtaataactatttaaaataaaactaagtaaagcagaaaatatatacttttctaacatttggagacttgtttgctaaattaaaagacgaagtgccaagactataaattactttcgtatgttgagggtgaatgtttaaattgtacttttttatttttaacagaatgtttactcatgagcttagcatttaaatggttaaaacaaggctttgaagttaacactccattaagatgaatgggggtaattcacacctctgcttgtgctatattatttcagtctggttgcagagaaaacaagacagcagtaggttgatttactgtgtgaaggccctttaaacacccaaggtctggaaatctttggggtgtgtgtgtgtgtgtgtatgcttttccatctagaagcaggatctgaaattcaatacaatctaggtatagaatcgaggtcttgaaaatactaaagattctctgctatccagcaattccatatctggcatttgacgggtagcacgttactggatcaacccaacctctctggctttgtttgctactgtactgtagtgtttcttcctaccacagcattttttaaacttcagcttagtatactggtaaatccatcagtggaaaagcagaaacgaattatccattttccggtgaactttgtatgtgccttcagatgggttatgagctaagcattggtcttcatgtgctcctttttaaaacattttcatctttgcaaaatctcctgttctatatttacctacatataaagcatctacctttaagaactttacaattttttctcatatccctggggtagtgaagtaagcagagatcagttgaaaaagagacatttctttctcaatgtgtcctttaaaccagttctatattgtatttgaaatgtgtattccacccattggtggaagtgctacagccatttgaccctgaaatgattcattttagggcctgggaataaggttatcttaacacaaatgaaatggcaaacactgtataagatgttaatgagtttggaagatctatctttaaggtaaacagatttttctcttctctcttctctgtcctgcatgtttgcaggctcaggttactgggtaatctgtgggtagctaggtgtggagagtacttccactctggctggctgtagtgctgacactgccaatacagtatatacagagagaaaatagatgctagaaacagagggactcaaactgaattaattttaacctgtttttctttttggcatgttaacagctctctgtggctgtgttagaattagccctatgttaaacatactttacttcctgcaaatttttctgcctagattttaggtgtcataatttttgaccttagaacatttcagaatctttttattgtactgagaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggagaaaaaaaaaacacaaaaacagatggatgaaaagacattgtaatatgggatgctataaagaaaaagacttgcagagaaatgtttctcacttgtttgagtgtacagtcatcccttgggggattggttccaggatctccctcatatatcaaaatccatgcacattcaagtcctgctgcagaaccacatatacaaaatatcaaccctgtgtaaacatgcgcagattttgcatcctgaaaatactatattttttatccgtatttgattgaaaaaagtcaactgttagtgaacccgtgcagttgaaacccatgttgttcaagagtcaactgtgtatatattttatctagtgttcatcagtggacagatacacaacacaagcaaaagggctggctaattcattcagcaaattcttagcacatattatgtcctagaagttgagctagtcccaaggtcatgaaactatgtaagacatacatacatcttgcttgaaaaaagttcagatacaacttttatttttctgactgaacattttcagaccaacttgataagtgaaattgcttaaatgaaaaattatacatgtatttttaatatatacatatgtttttaaaaaaagattttggagtcaaaattacctgtgttcgaatcccagcttctgtctctttctatatctttctaattttggacaagttactattctctgaacttgctgaagactcaatatttgactgggttttctctcaaccagaggaaactctccttcaagtgagattacatatttgggaaaaactcgagtaagccgttaagcattgaatatacgtacacttttattactttactgtccctcaaatcacataacttccaaccatgttgtctcttctgccgtctctgcttcagacatttagtcagcagcctgactagaaaacggtattctagaaatatcctgaccaatgcatttattttcactactgatgtatttttccccggaaaaagtaattcttgtagtttcatagtaaatattatccacatattttgactttacatcagcatttttagcaatgacattacacttttggcttataaagtatgtggtcagaaaagctgcaggccttttttaggtaaattaccctggtttctagaaccctgtacttgtgctgttgatttacattttttaaatatgagggaatatacatgcacacacacacacatatatatatatacacatatgtataggtacacatatacatacatacatatgtatctgttatctatgtgttaaatttcatcctgttagcttcagtgcaccacttaagcagttgagatcttttttttgaatcttgattctagtgcatcagtcaccattcccgcttttgtgacattcttcatcatacttacattttttcatcccattcacagataaaaatgttaaatgagacaagactaaccagagggccctgcagcccaccgctatcagtatttctcttgagttgttattaatctatactttggatgaagttgttaatattcctgtagtgtcatctaacctgcatttcctcacttcccttggaagtgacccccaaatcagtgggtacagcctaaactcctatctgttttctgtatttctagttgcttcagaacatttctgcttgggggctccacaatcacttcaaacttaacatgtccaaatccattcctcactacagttttctcatatctgtcagcagcccctgttttcatccaacatcccaactggctttcttgcttccattcctgctacctacagtccactttcatactgcaaagtagttgtttaaaaattcaaatcagattatattgctaccctgattaatttcctccaagggctttccatctcacttagaatgaaatccatgccatggcctacaaggctcaattttgtctgtacctacttatttctctgatgtcaatgtatctttcattctccagccacactggcctttctgcccctggaacacaccaagcttgttccctcacacttactgttttccctacttagagcataattttcaaagacctttgcaagccgggcttcttatttaagcctcgggtcaactgtcaccccctcagagaggtctgccctgcctgtcttatggtcatgaccgtcttatggcccccaacacatggtagtgcttttaactttaccctgttatacaggtcactgctggaaatcttgtttatgtgttgtctgtgtccactagactgaaagtttcataagaactgggacataactgtcttatttataaccaaatcctcagagcttaggacagtgcctggtactttggagtggcttaatatttgttgaatgaatgcataaaggaatctaacagactgtgtccttctactctttacctctaatctgtcacaatgtcagttcttctttgaaatgcctcctagatttgcttttatgctgacccagcctcctgccagactcctatctaaatctcagccttcatctctttgtgcctgaagtattgcagtgattatcacttcaggctgttctttggcatcacttgggcaactttgcaaaaattaccacatgcaggttccaccccaaccagttaaatccaaatctctgagggttacgacccaggcatcgataaacttcttagagcttcccagatgactccaatgcacaactactggattgccatatctacctgctagcagatgtatgtcttccagcccattttgcctgttactgttctctggtctccttggaatcctgctttcatagtattactctcttgctcaagaacctataatggctcactactacccccattaatcccagataatggctcactgctacccccattaatcccagataatggctcgctactacccccattaatcccagattcccttgcctcatccactaagctatatttgagccctttcttacgtatgttctacaatacccttaaactgttttttctgtctagcacttgatttgccttttattaccctcttctatattgttactcctctccctactcccacttccaggtacatacccagaatgtgacttattttccacctatccaaatgcttctcattcttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatgaaatcctttgcccctttgacttctctttacttaacattatgactttttttagttgtgctaaaacaaaaaataaacaacacctaacatgaaatctgccctcttaacaaacttgtaagtgtacgatatagtgttgttaattatatgcacattgtatagtagatacctaaaactttttcatccggcatgactaaaactctgtgcctaattgaacagcaactccctatttccctgttcctgcagtccctggcaactgccattttactttttgcttctatgagtttgactgctctcgccatcttgtaccaaggaatcatgtagtattttgtccttttgtgactggcttgtttcacttagcatattgtcctcaagtattatgcatattgcagcacatggaagaattttcttcattctttaaggctgaataatattccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttgatttagcattatgttttggagattattttgtatcagtatacacaaaactccctaaatattttaacagctgcatagtattctgttaatgcatagaccataatttaattagctagtttcctatcaatgcatattgagggattttttattttcaaatgttgcaattttatataatgcttcaaatgttatctttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctcaaaaaaaaaaaaaggaaaaaagaagatatactgatttatattcacaacaactatgtaggaattaccctttcaattttgtgttgttatttagcttttcacatttaaatactttacctctctgactccgttgtaattaacccaaagacaggaactatgacattacatattagcatctctcacagtagttggtgctcagtaaatatttgttaaatcttgtgtatttagggagttttcccatgagtggcgtttctgatgagtcccatgtgagaattgtcccctttgcatgtttgctgtttccaggaaagggtgtgattgtgtgtgatattcttaggcgagatgcttagtctattttgtgttgctggagcctgggaaatccaatatcaaggtaccaacacgtttggtgtctggtgagggccttgtctccactcccaagatggcctttgaatgttccaccctctggaggggaggaatactgttcctcaaatgacacataagtgaaaagagaaagcccgcttccaaaggcacttttattttattttatttttattatttttatttttaatctttgtgagtacatagtaggtgtatatatttatggagtacatgacatgtttcgatacagacatgcaatgtgaaacagtcacaccatggagaatggggtatccatcccctcaagcatttatcctttgtgttacaaacaatccaattatacttagttatttttaaatgtgcgattaagtaattattgactatagtcatcctgttatgctatcaaatagtaggtcttactcatattttctatttttttgtgctcatttaccattttcaccctgcccctactaccccacaacccttgtcagcctctggtaaccatccttctgctctgtatgtccatgaattcaactgttttgatttttagatcccacagataagtgagaacatttgatgtttgtctttctgtgtctggtttatttcacttaacataatggtctccagttccatccatgttgttgcaaatgaaaagatctcattgtttttatggctgaatagcactccattgtgtatatgttccacattttctttattcattcatctgttgatggacacttaggttacttccaaatcttggctattatgaacagtactgcaacaaacatgggagtgcagatagctcttcagtatacctattttctttcttttgggtatacactcagcagtgggattgctggaccatatggtagctctatttttagttttttgaggaacctccaaactgttctctacagtggttgtactaatttacatcccccccaacagtgcataaaggtcccctttccccttttctccacatcctctccggcatttattattatctgtattttttataaaagccatttttattggggtgagatgatatggcaattttgatttgcatttctctgatgatcagtgatgttgagcaccttttcatatgtctgttagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaataccattacattggcaattaaatttcaacgtgagttttggggggaacaaacatttaacccatagcagacaccattcatttatatttttcttccaggatcctgtattatcattaactcagaaaggccaactaatccttggatctattatcaaatttggtttgtttgaataattaagtataaattagctaaatggaaaggctctcctctgtaagttctttaccatctttttatgatgaaaaattttaaacatgaatgcaagttgaaataatatgcccatatacctaccactgaaacttagcatttggtcgtatttattttgtgactcacatataaattatatttatatgtaaatatacagttaactttagaacaacatgggttttctaactgtgtgggtccacttatatggggatttttttctgcctctgccaccccgagaaggcaagaccaacccctcccctgccttcttctcagcctcctcaacatgaagacaatgagaatgaagacctttatgatgatccagtttcacttaatagtaaatatgttttctctttcttatgattttcttaatgacatttttgtttctctagcttactttattgtaagaaaatagtatataatacaaataacatacaaaatgtgtgttaatcaactgttattggtagggcttacagtcaacagtaggctattagcagttaagttttggtgggagagtcaaaaattgtacacagattttcaactgtgtggtgggtgggcacctctgacccccacattgttcaaaggtcaactgtaaatacatttatatttgctgaataatttgcaaagtaagttactgacattccatgaagcagtaagtaaagttgaaaattattttttgtaaaagtcaccatctaccttagctcaggctactataacaaaataccatagattggatggcttaacagaaatttatttctcatagctctggaagctgggaagtccaagaacatggtgctggctagaattattttggtcctggtgagggcctcttcctggcttgcaaatggctgccttcttgtgtcctcacatggtggagaaagagtgatctctgttcctcttcctataaagccactaatcccattatgagggtctcaccctcatcacttaatctaaccctgattatctcccaaagaccccatcttgaaatacttgtgggttagggcctcaatatgaattgaggggttggaggagacacaattctgtccacagaactttctgtgaacaagcctattattccctccctccctccctccctccctccctcccttccttccttccttctctttcttttctttctttcttctttcacaaatgttgtccctttctccaaaaggataagaagctgcttgatgcagctgtcaccagaacttctcttagtaagggaaatatccttaatgtctttttttttttggtggtggtggggaatatcttgataagtcatttaggtatgaacggtgaattcttatacagtggcacagcaatgtgagtttactaaatgcctgtgaattgtatactttaaagagggtcattttatgttatgtgaatttcacctcaatcaaaaaaaatgtgaccctatgaaaatggttggcaagaggagaggaagtgagagagatagctaaaccactctgcataaaagagaaaatgtgaatttgggaactggagaaaagcaaagggaaagaggcagagagtgctaacccagtggtgggagtctagaggaaaagtggctgacgggcattttaagaacagaagcgtttaatattcagttttaatttgcctgtctctgtctcctgaaactaataaagtcagtagacacaaaaataccttgtgtgaacagaattgtgcatgtaaacccttctttagactcacatgggacagaacacatacagccttatgctatccaggtgatccagaaacctcaaaaagtgaaattcaaaggcagagatggccaagaaaaaatgtaagccacttgcttcctcccagagtccgtgggcacatcaggagggttgtgggacgatcctcatatgagggatgtgattgaaccaacttttcctaattctcaaagtgtattgaactttccttgacatctcattggcaatatattgtcatttcattgctttaagggctcattatttactagtcatcaattgtacctgtaggggaatgcctctttttagagacaagagaccagacctccacagaggtagatcttggagattggagcagttctagaatttctaacatttccccttacggtcatcttgctaggttctctgtaacaaagcctggtagttcagaaatcaggctccaagaacgtgccatagatcaacctgtttgtgtgtgtgtgtgtgtgtgtgtgtgtgtgtgtgtgtgtgtgtgtgtgtgtgtgtatgtatttgggatcagagccactcaacttcctttttttttgaaacggagtttcactttttttgcccagactggagtgcaatgctgtgatctcggctcactgtaacctccacctcccaggttcaagcaattctcctgcctcagcctcccaagtagctgggattacaggcatgagccaccacacccagctaattttgtatttttagtagagacgaggtttctccatgttcatcaggctggtcttgaactcccgacctcaggtgatctgcccgtcttggcctcccaaagtgctgggattgcaggcatgagccaccacacccggccttcaactcaacttctacttagatggtggcagtaggaatcagagggagtggggcccctagggaagagcactcccatggaaaaagagtagaaacaaattttataattccctggttttcttacccagttctccaacctgctaaaatctgaaaaagtttcatactttaaatgaatggaagatcattagtctcataaaataatatgacactactgagctggcacttcggtgtatagaccaggttctatgccaagcacattctcatgtaatctgaggtaagcacagttatattccccatttaatagattagaaattaaagtttagagagactgtaaggttaaatgacttgttcaaggttatacatccttaagatgccatcctaagaatagaaactgaagtttgactataaaggctgtgtgcttaattaccatgtaaataaagtgtatccaactgttggagtttttttctacaaaaaggttctgctcatagcagatacatagtcaatattgactgtgttgaaggctgctttattcatttaaaatgtggcacctaaatctgttctgttacatcagccagacagtattttggccggccttgtgtcctcttgagtcatggttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagatacaaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttttctactcaactctcccaaaagatgtctaatcactcccacactcagttacttaaacatttcataatgttgttacttctatagtaaaacaaaaagtaatttgcttttaataaatcagagagccctactgtagcaatctagaactttattctggcgagagcaaattctcaaattatatttccagcctcatttgtgaatagctgattttccctgtcacaaagcattgttaggtaggtacagtatttttctttagttggtaaactactggaacttacaatccaatggaggtgacctctatacaatacctgggacggtaataccctgaagcgcagggtgtggctattgcatgtgccacatgcacatgaggccatctgtgcgtgcttgttgaaagaatgacatatcttggtgagtaatatgaacattaaaagctctgctggataagctcatagaggtggggttcactgccttctgggtgagtggggaagactttgtgaagaaagcaacaactgaagtaaaattgaaggataaccaaagtagaaatgagaatgaaaggaagatactcctgtttggaaagaaaatactaacaatatgtacaggaaaatacaaggtatactttggagatgacaagtaaaaattttgccaggagcacagatgtaatagcaatttgagaagtaaagctgaagggtaggatcctgatgtagagaatgctggacccaggctgagcttggactttacatcaagtagaagtggtagagaaagattaattgcctctctgcattggactagtgccatcgtcttccaaaagctaaaaagaagcactttaggccttcaagggctagttatctaaaaaccacacttgatttgttcttaagtctcagctcctgggcatatgaggaactttttctggagttttggaaaattcctcatgccctcagatcctattaagacctctggcatctttttttttttaattatttaatttatttatttttattttttattttatttatttatttatttatttattttgagacagggtctcattctgtcgcacaggttggcgtgcagtggtgtgatctcagctcattgcaacctctgcctcccggactcaagcaatcctcccacctcagcctccagagtagctgagactacaggtatgcgccaccatgcccagctaatttttgtactttttgtagagacagggtttcaccatgttgcccaggctagtctcgaactcctgagctcaagcaatccgcccactttggcctcccaaaattctgggattacaggcgtgagccaccgagccaggtcaagacctctggcatcttaagagacttcctatgagttcctgcctccaaacttttttttttttttttttttttgagacagagtctcgctctgtcgcccaggctggagtgcagtggcgggtattggcttactgcaacctctgcctcccgggttcaagcgattctcctgcctccacctcctgagtagctgggattacaggcacacactactacacctagctaatttttctatttttattagaggcggggtttcaccatgttggtcaggctggtctcgaacttctgacctctggtgatctacccacctcagcctcccagagtgctgggattacaggtgtgagccactgtgcccggcctcctgcctccaaacttttgcacaaaccattcatgttgtttttctctttcccctccaaagcgtttcttctccctcaaaacctgtttccacactcaacctcctctagaaggacttacctgactatgacttaatgtaactgctccattactcaggaaacctatgctcaacatcttgatgctacatttaatttctctaaatgataaaatatacaaattcttgtatatttgtatgtctaaccaccctgcgacagcctttaggaaaggttccacatctgccaactcctttgtatcctccatccagaacctgcctcccatccctactttacccatccacctcagagacttcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtgcatgttagtggttaatacagcagccaggagacgccagacagctctcggcacctggttcaaatttaaggctcatttacacatgatgtcacacacgcattgtcagcgcgagggaggtcaggatggttcattttgggaaggttcacattgttgagtctttacaacactcactgctattaatgctttaaccatctgacttggatttcggttttctggcatgaggtaatcccaggcactagatttatatgctgaatgggaagccagcaatggtggctaatcatgctggtttgcagatctgcacctctggagccttgggatggaattagagggccacatggcaagtagcaaatcataggcgttttgagcaggagaggaattagccagacctggaagcaggggccatagatggggtgttgtctgagccaggaagtttgattgaagaatggaaaccaaggtaaattggacaaggatctgggcccagagaccacaggaattattctactttgaccagtgctttgggtcattgcttgaactgtccttttgctcatcactcatagaaatcccagacccatcttcccaggtccagcgtaagtctttcatgttccatgaagcctttcctgaccacccatcccacagcaggggctgaggtggttagatcaccagaggtcagaagttcgagaccagcctgaccaacatggtgaaaccccatctctaataaaaatacaaaaattagctaggcgtagtagtgtgtgcctgtaatcccagctactcaggaggtggaggcaggagaatcgcttgaacccgggaggcagaggttgcagtaagccaatacccgccactgcactccagcctgggcgacagagcgagactctgtctcaaaaaaaaatttctctcctgaatccctaagtacttttgttactgagtacttaatttgtgcgactagctcattttaccctcacaattccaaagggaaggctttattatttctcttttacagatgacaagacaggttcagagaggttaaataatgtatccagtgtcaaacttttaaaagtcaggatggaatcctgattccaagcttaggttctgaaccactggggtaggctgtgtagtactacattttctgtggaacgtggtatcggtaacatgggagagacaggctgtgcctcaggaagatgccacatgggagtgcacagcagtgctgtagtgcctcgtgtttatgtgtagtcccaggtgcctggctgtaaacaactgcagggcagtgaccatcacctctgcttttctgcatccccacacttcctaacacagtgtcccccaaagtgtgcatcaatggatggatgaatattagcacccccgcaccaccctcacctaaaacatactgaaaagtttgagatctttggataaccaccccatcccctgctgttgtcttctgtcatacggctgaaatcgtaaaactggtctgcctgtcacagctccagtgagcctacttactcactggaaattcagagaatgtctttagtcctgttgactgctttgattttgttttttaacttgtaccaagacctgttgccatgatgggtctctgcaaatgggctttcttgttccatgagtctctgttttagtcaagtgaagggcacactccttttcattggccacctcttacttttcctccaagaggagtactcactcccagaaccctttgctgggctctcatgccgagcttaggtgccccttcagtgtgcttctgcagcactcattaccccgtagtagcattgtagtttaattcctgtttgcttgactgaagcagagactcacctgcagacgcctgtaggtgccttccacgttgctcagatgaacagtagagaagggtcaggcctgccctaggtttctacccctctcctcaaggccctttctagtcaccacgccacatcctgctcatgactgcagggatcatgcctctgggcctctgtccatgcagctgcctctgcctgcactccaggacaggggccttctctgctgtccactggagccctgtggaagggactcctgaccctagccttagggaagtcatctctaaaggctgttttattacagtgtttcctcagaatgaccctatagacacagtgttttctcagtgtcctctcacctttgaacatatccgggaataattgaaaaaaccaggcaatcaaatgtgcctctcataaatcaccatcacttcagagcagaacttaagagtttggtttgcaagccacaccaaatagtttgagcttggccctctaccatttcctcctgctctgagcccagaggttcacctagtggactgtagcaatggattcccttgcccctggcttcctgttgggttcagccagagagcagcaccagtgggagcctacagagggaggaaagtgaggtcaaggtgtctgctgcctcctccctgcctgccaggccactgtgggtagactacacctcaggtggccctccccatgtgtagccatgcttgccaggttctgggttctggaaacctccacctcctcttgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 1082 - DNA, 71431 bp, Homo sapiens
cgtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaa

SEQ ID NO: 1083 - DNA, 102621 bp, Homo sapiens
cgtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgtaagtgggctgtgttcgcttccccgcgctgacgccctccggcttccctcaagtgcctgccaaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagttagtatttttgtcaccttattttctccaccagtctcgtgaggtctttgcaagagtcacaggattttcctcttccgacttagtcatggggggagggaaaataataaacattttaatacagaaattcttagcggtagaatggaagtggcttggtagtaagtgcatagcacgttcctgaccctaaagcctgtgcagtgggcactccgctttttaactcgagtcctagacactgttcccaggactttgttcccggtgctgtttgtggggagggggatgttttcagggatactgccagaacaacgtgaattgcttctgtttataatattgtcattgcaagatattcctgaccatccttccagtttggtagaactaattcattagatatataagtagagattagttgtgcagtcctagtaattgaggagaaacaactgcccacagcagtcccaggttgactcagcaattctttagtaatcacatgagctgaggccttatccctcctctctctccccactccattcccatcctatcttcatctcttgcagtcacaaggttagtcatggcccttcctgaactctgcctgtcttgtgtactggtggaaatcattttcctaagaaaccctagattcctggagctgcagtagtgggaggtgggaaggaaaggaaaggaaattagtgttggttaagcaacgagtgtgtcatacaaaccctggtggtttgcagcttttttccataatctttcatttatggaatttctttacgaaattttaacttcaccgtccaaacatttaacactactaaatttgtgtgcttacaggaacttcacagacagcgatccccaggtgtttcatttggtttatcagtgtttaatttgatgaatgccatcatgggaagtggcatccttggcttagcttatgttttggctaataccggtgtctttggatttaggtgagtcttcatattttagcatcaaatttttttttccattttgataatatacggagaagtagagagatagattccagaagctgctattatacaatttctagttagttatttctggggttttagcatttttcttgttattcttgttgctagtgtgtaccttggagggctactacatagcttcttaaatacacagaagtgtgactagtttttaaaaatgggaacttgatccacatttcatttataatgaaatatgacacttaagagtggcatattcattgtatctccttggccaaagtgaatcaaagccatgcagattaacttccaaatagcaattttgtgagtgcaaatacaacacataatcttttcattcctcgctgtctctttgtattgttaagtagtcttatttcactttcagaggccagacatgtgttttgtgcctgttcttttttatgtttcaggacttagcttgtaggccagtttgcccaaaatagaagacaatcctggatattctgtgctttcatagtactttgtatattcattctgttattataattgttacaatgatatgtttggaaattaatgttcccactaaactgaaatcctttacaactggaggtcaaggcaggcggatcactggaacccacgagtttgagaccaacctgggcaagatggtgaaaccccatctctgcccaaaatacaaaaattagcctggtatggtggagtgcgcctgtagtcctagctacttgggaggactgcttgagcctgagaggttgaggctgcagtgagccatgattgggctactgcactctagcctgggtgacagagtgagatcctgtctaaaaaatttaaaaaatagaaaaatcctttataactggaccttattcttagcatctagcaccacatggctaatagaatgaattaacaaattggctttgtcagtagaagcagatctatttactaggaaatttaaaatgcctagggagtctcttttatgtttatttcctgcttttattccaaattttttgataagcaaagcaacttttaagtaacccaacttgcttttattatggaatgtactcacaaactttcattatttttaaaattaaaaactatatgtgacaccttaagcaagacatagtcagaggactttttttttgattctctttgaaaaatcataatttatgcaccagggtcttacatgcagatatatactgctgaatgtgtgctcacccagtcatagcaaccatcatttttggtgatgctaaagtgttattttgtgaagttcctgatgtcagtttaatgacatttgtacttttacctctcaattttatttattaacaagtattaactggaccacagagagaaaatttcttcaatgactggggcagttcactggggatagctgtatagaagcttgtcctgctggtgtcttcctaaaaatgaataggaaattatctaagttttttctttcacactgttggtgagaggacctcaatcattacattgtttgcacatttttcaaattgcatcattagaggtgtgttaactacattattttaatttagtttggtttggagagtgtgtgcgtttaatagatgctagaaaatacagcctaaataaatcttaagtacaccttaataagatgaaggtatgataaggaggtcaatatcactggaagtagagggaggaagggaaaaagagaagacaatgagattgcataagtaaaacttctgtttagacttaaaataagaagaaaaccagtcataaaaaggaaatattacaagattatttaatggctgattcagcagtcagcagacaagactgcaaaatgaggaagtttgcttgtatttttaaaaaagtttggtttttatttttttttattttaaaatcagtatattttcatttaaataaaattggtaaatacaaaaaagtagaaaagtatcttcttaatttccttaatgaacataattctgctactcagagatagttcctgtgaatatttgactgttaagcaatttgtttttgtaatgagacaccatacaaaagacaaacttttgggaggttttgaccaggtgttcttttatgttttagcttcttgctgctgacagttgctctcctggcttcttactcagtccatcttctgcttagtatgtgtattcagacaggtgagtaaaaatgttatgctgcttcatttaataaaggagtctcttgagtttgtatctacatatagaactggatgtctcaaatctaatatccagtgagcatacatttttattagatagggtgatcggaatggagaatttgaaaaaccaggatatacagacccaatactgtgggggaatatccaagcacaggatgggaggaggtaattagcatttttacctgctttcctccacaacacaacctaattttctggagtagagtagatcatgggagggtctaaaaggtgttcaaaggatccaaaccttatgcttatggagaaatcattttctcaaggagagaacaccttctcagagctactgttgccttccctgcccccatctgcctgctagtcagaggtagggatggcagaattaggattgtaggaagtaaggtcacaaagctttaatttatttagacacattttgtatttttaattgcaagtctagaatagggtagttttttcctaagagaaataagtatgtgcagttaattcaatatatttgtgtatatactttttcccatttggaattttattatgcaattcagtcatgtattgaataagttcttttaggatccagtaaataaaagtatatgaattatagaagtgcttttctaagattttccttttgtcattaacaaatattctatgttcatcagtcctggtctttttatctgtctagtctcttttgtctttggattaggtcagctttgatgccaaaatcatgggtttaattcttatatggatgagttcgttttgctttatctggccttgtgatgttcagattttaagaagaaaagtagatacacaaaatagataaaaatggatttcttaattcatttagtgtttctataaaagaatacctgaggctgcataatttataaataaaagaggtttattttgctcatagttctacaggctctgcaagaagcatggcccttcttatgaggggcttttctgctccatctgcatctagtaaggggctcaggctgctttcattcattgtggaaggtgaaggggagctaggatatgcagagatcacatggcaagagaggaagcgagagaggaggggcatgccaggttctttttaacaaccagctctcatgaaactaataaaagtgaaaactcactcattaccccaaggaaggcaccaagccattcatgagggatctggccccagggcccaaacacctcccctttggccctacctccaacactggggatctgatttcaacatgagatttggaggggtctgacaaaccaaactatatcagtgagactattctgtgctgaaacaggtgagtgaagcccagtgatgtttcttaagaattttaagactcttcagaataattctgaagccactgctctagtttgttttcctaaaacctgtccatcatcagaaatactcatagatctttttatacacagagagctctaagcctcagggattctaatttcaaaaatctgaggtgagactcaagaatatgtttttaacaaggcaaaaccagtttaggatccatagtttatagctctaacttgtaccagtgctttggccagccagtgccagatatgtttttaacaagtcctccaagtgattcttatgcaaatctagtttaggattcatagtttatagccacaacttctaacagtgctttggccatccagtgcacgcctttgctctcaaggggcttgggtgaatgtgcagacagatgaaaatactaggaagcagtacaaatattaatcctaaagtaacaggttgttcataaaagcatcctgaatttaggaataatagctttagataaatatatttgtaaatcctgctgaaacttgaattttaattgcatgtattgaaattttgctgaatgtgaaaaaaattttacttaattgtgatactttaacatcttggtagattctttcaattcattctgttaaaagattaatactttagtcaactatgtggcaattatgtctttcaagcttcattttaaaacttcattttagttttaatttaagtaaaatgttttatttcggttatgtgggagtagtattcagtgtgtggagatttctaagtaattttaattttttactccttcggttcacatgtatttaactttaagattctgacactgtgtttgttcttttctgtaactctggggcgtatgaagtgaatatatctgtttctcttcttttttctttttctttgatttctgtagcctacttgggcccatgaactaactacttcatggttctgcctgcacattgactcacctgtcttccgttgattgaattccttcaatctttgtaaaattctctgtggaggtaggcttttccttttttttttttttttcaatacatacattcatatataaagactagagtataatacgtaactaactctctcccaacagtttgttggactgtcataaaggattattatgctcagattgaattcattggtaagagaaagagctatcatgagtttttatgaaataacttcttcatttatttgctggtggtaaagggtaaagagaaattttcatctttataaaagtaaaggatttcttcacatgaaattctactttagattttatggagcgtttggggtctatcaggacttttcatgggagctgaggtggaatgtaaagaaccttattctctctagccttcgtttgtcatctgtaaaatggcaatgataacacttccttcttggaattgttctgagagtgaaataaaataatgtatatgaaatgtcaagtccttggcaaatgagtgctccctggggcaaaaatgcccactggggcaaaaatccctaaagattgcagggtgttgtacacactactatctcagaaatagttggttcgttgccattcttttggaatacttctcatgctctgatactaaacccacagctcccctccactggcttccatgtcactgtcaactggagagagtgagagtcctagaactctgcatacctctggccgaaccacaactccctagtcgttgatccctactactcactggattgtcaccattatttgccttgagaccatttggattatgacattataccatctatctcaatttgtgttagtcatttcaagtatattaggttatctttcatttctcagactcatcccatatggctgtcatctgtttctgacctcgtcttccactgctctctaactcctgaaacccttccactgtgctctctggaactcacagtcaatcatcagcaaaactcacatgtctctaattctcttctgaacatttctgtctgtttcttacactacgagaacctcctctgaggcttccctgtagttctctcaagtggtcagtcttttctctttatgtctctcatactaatttgaagatggtataggtgtcctgtttgtcccacatttctgcttctcaaccatcttcctctccttgaaccccccagcttttaatctcatgaatgtataccatctacggctctccttactattgtcatctatagactcctagaccatttcctgtcatttcatgaaagttttagctaaattttagcttctactcaccttttagttctcttcagtattacccctgttataattctggatgatttcaatatgcatgtagctaatccttctaatgctttcagttcctgaacctcttcttctctaatgatcatattctctacctacactggccacttattttctcctatggtcataccactgatcttgtcattaccaaaatagcatttgttagtatctgcccatctgccaccaccatctcctttgtttctaactcaccctctcaagtacttcaactctgacagttttcacccctaccaagacttctatcaattcattgattctaccacctttgcactgaccccccacactcattcttacttccctctttatccagttgaggttttgtagtatgttatttaatcccttgcctatcccttgaaccatcatatttccctggtaaaattccaaccatagttaaatataactctgcctgcttcacatttgcacccatgcatttgaatcttcctgaggaaaagcacaaccatgcagactgatatcactataattcaacgtctagtgtacctatgatgctatcacacaattctggttcacttctttggttcatcacttcatttagctcattcatctgctatctaggagattgcttttttatatcttctcctgtcaaaccttcgacacttttttctttgatttcacccataactgatattcttcgctttctgtttcactgaaaaaatagaagcaatcataaaagaattttataagctcttgccaccacttatttatctgtgcctatatactctgttccttgggatgaattctttgtgtttatttctaaggcctaccccccaacttgtgctatgatcccacctgctcttgcctacatcactccagccactttctcccttctttcttatttcttggcccttttctaccatttccttcctatcattttacaaatagtctaatttctgtcatcataaaaatctcttttactttgcatcttttgaatatgcctcatgtcttcatgacagcactccttaaaataattgtctaaaccaggccaggtgtggtgtctcatgcccgtaatcctagcacttcgggaggcagacccaggaggatcacttgaagtcaggagtttgagaccagcctgggcaacatggtgaaaccccatctctacaaaaaaaaatacaaaaatttgtgtgaggtgacatgagcctgtagtcctagctactggggcagctgaggcaggagaatcacttgagccagggaggcagaggttgcagtgagctgagatcatgctgttgcacttcagcctgggggacgggagtgaaaccctgtctccaaaaagaaaaagaattatctaaaccagatgtctccagttcctctcctcccactcctatcaggcttttccactgaaactgttgtagcagtgacttccacattgctaaatccaatgatcagttctcagtcagcagcatgtgacagagctgataactccttgctctctgaaagacaagtcacgctttcctagttcttcctgtttcatcaaacactccttttctcttctgttgaattctcttaatctccccatcctctaaacattggtgtacccctgggactattcctctgatctcttttcttttcccttcttttcttttttttttgagacagagtctcactctgtcacccaggctggaatgcaatggtgtgattttggctcactgtaacctccgtcctgcagggttcaagcgattctcctgcctcagccgtctgagtaggtgggattatagatgtgtgccaccacacccagataagttttgtatttttagtagaaacagggttttgccatgttggccaggctggtctcaaacttctggcttcaagtgatccacccaccttgtcctcccaaagtgctgggattacaggtgtgagtgatctcttttcttttacactcattatcgggctcatggtgattctgaaatttatatccctggcctggaactctcccctgaatttcagtctcatctccagctgcctccgtgacatctccacttggatgtctaacagctcagatttgtaaaactccccatctttatactaccaatctacactttctactgttcccatctaagtaaatggtaatgtctttcttctaattgcttaggccaaagatctttaagttattctgtatctcccctttttcccctcatcctgcatgttcagtccatgccatactgttcccttcacttcaaaaaaaattttttttcgagatagtgtcttgctgtgtggcccaggctggaatgtagtggcgtgaacatagctcactgcagcctcgacctcctgcctcagcctcccgggtagctggtaatcacaggcacacatcaccatgcacgtcaccacacctaactaacctcagcctcctgagcagctggtactacaggctatgtgcgtcaccacacctggctcattttttaattttttgcagagatgggctcttaccacgatgcctaggctgttttccaacaccagctcaagcaatcctcctgccttgacctcccagagtgcttgggattacaggcatgagccatcgtgcctggccaaaaaattaataatctgataattttctcatttaattgctaccacccatcttcagttactattaccaccatcaaaagtaatagtttatctttttgtttttacttccactcttacttcctgcagtctattcttaacaaaacaaccataatgatctgttaatgtaagttaggtcatagcattcctttgctcaaaatcctccagttgcttcccagttcaatcaaagtaaaagcaaaaatcattacaaagtccaacacaagtcttctgccctttttatctccttgatttatcttccagtactccctcactggtttcagtcacacttttaatttttatcttatgtaacatatacttatatagcacttagcatcattctaaggactttatgaatatgaatattcatttaatcttcataataatattatgaggtacgtatcaatattatttccattttttgaaatgaggtaactgtggcacagagaggttaaagtaacttgtccaagagaggtgaaagtaacttcccagttaggaagtataggagccaggattcaaacccacacagtctggctctaaaattgtgctcactcttccccagtcgtgctgggtagtctcctgcttccatacctttgtgctttctgtgctcttcttggacgtttcttcccccagtttcccacatgactttgctcactcatcaccttcaaggctttgacaaatcttacctcttctgtgaggtctttttatacaatctcatttaaaattacaaacagcaacggttgatctacagtgtcatcaaggaaggaggatctacctttctgttccattattcttgtgtgtgccttccccatccttgaggtctaggacgacttgtggagtgcagacatcgcatccgtgttctagagagcagaaagagagaaagggatgcctaccagctgaatctcacttaagactccattttcttgttgccagaacttaatatgcccgatggccatactaaattgcatagggacctagaaaatgtagcgtttattaaaggtggcaatgagcccaactaaaagtcagggttctgttactcaggtagaagaagggaagagacaaccagcagtctctaccccaccagggttccatctttatccgtacttgtactttactatctttgaataacattataaacttttatagcttagctaccaaaaataggttgacgactctcatccatgctgccgaaacatatcagctacctctgatattggagatctccatttagatgttccagaggctttgtgagctcaacgtgtttaaaattaaacttatctttcatctttaatggctcaaatgtgctcctcttcctgtaccgtacctccgtgaatggtaccaccagtttatatctccttcacctcgtacattcacccagttataaattaattttgtaaatatttctcggatctgcctaattctccttccttattgctactgtgtagatcacgccataacccctccccaggattacagtagagttaaatcataacaggtatttaagttcatgtcattttaattcatacagttcaaaagtggggaagaaaataactttaaatagtgctgggtaatcctgcctgtattctactcagtgaacatatattcatctggggactgagtgtgaggtgggaaatataataatgttgctccctctgttatattttttttctttaaagataacttttttttttttaagacaaagtctcgctctgttgtccaggatggagtgcagtggcgcgatctagccaaaccgcaacctccgcctcctgggttcaagcaattctcatgtctcagccctctggcatcttaagagacttcctatgagttcctgcctccaaacttttttttttttttttgaggcagtcttgctctgtcgcccaggctggaatgcagtggtggatctttgctcgctgcaacctctgcctcccgggttcaagtgattctcctgcctcagcctcccaagtagctgggattacaggcacccaccaccacatccggctgatttttgtattttttagtagagacggggttttacagcgttggccaggctggtatagaactcctgacttcaggtgatctgcccacctcggcctcccaaacggttgggattacaggcgtgagccaccgcacctggccagataacattttttagcatactgtcttcatggtgctgttttaagagatttgcatgtattattctcacaatagcaatgtgaggtagaaattgttacatccactttagagataggaaactgaggcactgagtgattaactagcttgcttaaggttgcacagctagctagttagaagagctaatattcgatttaggcaagctaactccagagtccactttcataacactgtgctgccatttccccactattataggaacctggaagcttattttctggagaaggtaaactaaaaggactcagcaatcatagatattaggtgtagttaaggccaagatcaccttactgaaaacagggagattaagtgaaagtctactaactgaaggagagtcccagttagtaggagttctgagactgctggcagcaagtcttctactttcacttaagggattggaggaatattttcaacagaatttctcctgcccaagagaaaagacctacaggtaaaaatagttgagggcccttcaagaaagagctgagtacctcctgtttaatcatcatatagttaagcataccactcaataagcctcttctgtgtacacagagcttgtatttagtcttttaatgcatcacacttacgtcaagaaatagccaagtatcaccagatatttcaggaaaacctttaatgtgaaagatatatactaaaacagccacatacacacacacaagccaataatgagatacctctacacatgtattagaatgacaaaaatctgaaacactgacaataccaaatactggcgaggatgtgggacaacaggaactctcattcattgctggtgggaataagaaatggtacagctactttggaatacagtttggcagttttttaaccaaactaaatataatctcatcataggatccatcagtagtgctccttggtatttacccaaatgagttcaagacatatttctacacaaaaacctccataaagatgttaataacagccttatatttaccaaaatctggaagcaactaaaatgttcctcagaagtgaaagaattttaaaaactgatatatttgtacaatgggatattattcagcactaagtagaaatgaggtgccggagccttggctcacgcctgtaatcccagcactttgggaggccaaggcgggcggatcacctgaggttgggagatcgagaccaacctgaccaacatggggaaaccctgtctctactaaaaatacaaaattacctgggcgtggtgctgcatgcctgtaatcccagctactcaggaggctgaggcaggagaatcgcttgaacccgggagttggaggttgcggtgagctgagatcaagccattgcactccagcctgagcaacaagagcaaaactccgtctcagaaaaaaattagctgggcatgatggcgggcacctgtaatcccagctagttgggaggctgaagcaggagaatcgcttgaaccccggaggcggagactgcagtgagctgagatcatgccattgcactccagcctgggcgacaagagcaaaacctcgtctcaaaaaaaaaaaaaaaaatacccagcatggtggctcacgcctgtactcccagcactttgggaggccgaggtgggcggatcacctgaggtcaggagatcaagaccagcctggccaacatggtgaaaccccgtctctactaaaaatacaaaaattagccaagtgtggtgacacacacctgtaatcccagctacttgggaggctgaggcaggagaatcacttcaacccaggtgatggaggttgcagtgagctgaaatcgtgccactgcactccagcctgggcgacagagcaagactccatctcaaaaaaaaaaaaaaaaaaaaaagaagaagaaatgaggcatcaagccatgaaaagtcatggaggaatcttaaatgtatactgtcaagtgaaagaaaccatgtgatccagcaattcctcttctgggtttatacccaaaggaaatgaaattggtaccttgtagagatatctatgctcccatgttcattgcagcattattaacgatagccaagttagagaaacaacctaagtgtcagtaagtgagtatataaaaaattgtgatatgtacgtacagtgcaatattgttcagacttaaggagatcctgccattttcaacaacatgcatagacatggagaacattatgctaaatgaaatgagccagacacagaaggaaaaatactgcatgatctcacattcatgtggaatctaaaaaagtcaaatacatatgaacagagtagaacagtggttatgtgggggatgggaagatgttcatcaaagggtataaagttgcagttatgtagaatgaataagtctacagagctaatgtacagcatgatgactatatgtaatattgtttactgaaaatttgccaagagagtagatttcaggtgcttttaccacaaggaaggaagaaagggaggaggaagggcaagagggaaggaagggagggaggaaagaaaagataactgtgagagggtagatacgttaatttgcttgactctagtaatcatttctctgtgtatatcaaaacatcatgttgtacaccttaaatgtatataataaaacaaaaaaatctgaaaaggctacatactgtatgattccaagtatgtgacattctggaaaaggcaaaactatgcagaaaataaaaaagatcagtggttgccagagtttagcagagggagcgtgaataggcagagcaccctcacctttaggacagtgaaatgaatctgtatgatactataaagtggacacgtgtcattatatatttgtcaaaacccatagaatgtacagcactaaaagtgaaccctataatgtaaattatggactttgtgtgataatgacatgttaatatagatacattgattgtaacaaatgtaccactctggtgcaggatgttgattgtaggggaagctgtgcatgtgttgggggcaggaggtatatgggaactctgtactttctgttcaactttgttgtgaacctaaaactgctcctaaaattattaaagaaaacacaaggaaagaaacagactcagaggaaaagaggaaacagacaatacaagaccagatgaaaacttaaaaagctacatttaataactttagagaactaaaagaagatcctgcattcttgaaacaaaaataaggaattataaaaagggtatattcagaaaaccaaaagtcctagaagtcaaaattagttcaattgttgggttgggagagttacagaagtttcctgggggtggaaaaaaagagaaagcttgaaaatgggagagaaaagataagaaaattagaagatcagtccaggaagtccaacatgcaaataatagaaattctgcaacaagaaaaaagtaaaagggatggtagaaaattattaacaaaataatacaaaaattgatgtaactgaaggaaattagtttcaagattaaaagttttcctcccggtatccagtataatacttgtaagataattgttacccaagacatactgtgaatgatcagaaatccagttatatagataatattctaaaagcttacagagagaaggaacaaacaacacaaaaaaaattcctgcaaagaatcaagaaccacagtagtgaaagtcttcctaggagcaatactgtaaactagatgactataaaacaatgccttcaaaattcctggggggaaatgattttaatatagaattctataactagccaaactgttgcttaagtgtgaagtttgaacaatgacattttcatatatacaaggtctcaaaaatttttattcacccttacttagtgaacaatagagtataccctttaccaaagttagagagtaacaaagaaacaaggaatcaggcacaggaaagaagtggagggaattcccaggacataactaagcagcagatctaagcaccatctacagattggagttgtgaggttttttgtggttttgggagggggtgtttagatgggatctcactctgctgcccaggctggagtgcagtggtgtaatcttggctcactgcaacctccacctcccaggctcaagtgatcctcccacctcagcctcctgagtagcttcccacctcagcctcctgagtagctgggactacaggtgtgcaccaccacacctggctaatttttgtactttttgtagagatggggtttcaccatgttggtcaggctgatctgaaactcctaagctccagcgatttgcccacctcagcttcccaaagtactgggattatagatgtgagccactgcctggctggagttgttcttttcacaaaggcacagtcctcgctccaggtcatgcctgccctctggattgtgttcaggatggaaactcttttcttattcctctgagtaaagggattgtctttctcatttgtcggtctaactcttaatttgtgttaacagtgcttgagtagattagcagtcaggccgggctgttaaaaaagtcagaataaaatagggattgaaccaaggtagtaataaggtgaataaaagaaagaaacaggttaacaaatggtggggtgcagcagagttccagttgagaggagctgatatctgagtaaatgtggacaataaaggagaagtagatgtctggtgtatctcccaggtttccggcttgagccactggattaatgatagtgtcatcaatgaagataggaacacagtaggaggaggttgttcaaaataaaaatgagttcagttttagacttatatgtaggtggacaaggcttagaactgaagcacaggctagaaattcattcattcaatactcttgtctactaataagaaagagataaataagagccagttacttccctgaaaaagctcatagtctaataggggaaacaaatacataagcaaataatttatatctagtatgataaatttaacagtttaaatatgtataaggcatagtgatatcttagaagagagagtgactttgatatgggcaggaggcagggaaatactgggtagaagagggtggttccccagcaaaggcccccaccccccaagcctggaaacccatggccctaattgggaacaggcatttctgttttcatgtccaaatgttgccttctgcctgccatccccgcatcctgtacccatataaaccccaaattccaggtccacaggcaggagagcagacaaacagaggagcagaagaggagcacagtaaaggagagaagagaaggagtgtttgaacgtcaaggagaggtcggttggggacagctggagaggagattggccatgggacagcagaactccaggggaagatcatcttcccactccatcccctttccagctccccatccatctcactgagagccacctccatcacctaatacaattcccacattcaccatccttcaaatccgtctgtgacctgattcttcctggacacaggaaaagaatctgggtacgaagagggcactgggctggttaatacttaagcaatctgtggaaggcagagctaaaagagcactgtagcatgcccactggggcttcaggagttgcaggcatgtattcctagatgctgctgtggggctggagcccaaaagcgctctccccgccccctacacctgccggtctgcgagctccgcctcctgtaaggggtttgagagtgcagcagccgaacagaacagacaagccacagccctgtcgcaggccctgcccttcgtgggggatcaggggactctcccgtttcaactttcccttagttggagggtgagggtcagtaaatgttcatggacaactaagctgaaaaggaatttgactagcagacaaggcaagagagaatattccagcatgtgcaaggatacaaagccatatactacctattgtattcaaagtaccaaaaatagtttactgttattagtagtacataaagtacaaaggagaaaattaaactggagagttagacaagtctcagatcccaaggaatttgtagtttttgctgaagcagtgagaagccactgaggttgttgaaaaagagtcaaagtagatactggaatccactgttggttgcttccaaaaagaattttggtcctttctagtgcccagaacataatctctttctctggcaaagaaaacgtagtcttctgtcttccttttcctaaagaaggttacaattattttatgaagattgtaattttgagtaatgataatggaataaagaaggagtgaaatggcctttgtgtgctcctcattttttttcttttttaaggcaaaaaggttttaaaaccctctggagcactgattctgaataccttctttttataacattttctaaatgctccctttactatatgaaatgaaattcccataggtattataccctactgcagtgagctgagtaatgcttcccgaaaaggtagccacatcctagtccctgaaacctgtaattgttaccttatatggcaaaaaagaactttgcagatgtgactgagttaagatgttgagatggagagattatcctggtggactctaaattcagtcacatgtatcatggagggaatatcatagaggagatgcaggcaacatgacctctgaggcagagattggaatgacatgaccacaaatcaaggcatgccagcagctaccagagactgcaagaggcaaggaatggattctttctagagctttcagaagagtggccctgtggacaccttgatttagacatcgtgaaactggttttggatttctggactttagaactgagaaagaataaatttctgttgttttaagccatgaagtttgtgataatttcttacagcagccttaggaaactaatacactacttacataatataatgccataacaatgaaataaagaagacacaaaaagtaaatgttagtgatgtgactttccatttaggaaacaattttttgcaaagttccaaacaaaacaaattatagtcttttctgcatttacatggtaattgtatttctggaaaatttaatatatattcaaaccattaaccaatgtttgtagcatctgccatgtgcttgacacacagagagtatttaataaaagctggatacatgggtgatgaatagatggatgtattaaagctacaaagagagtacataagttccaaaataaacatgcaaggcaaaaattatgtgtagtcaaacgtatctttaaaaattcttgggcaggcccagtggctcacgcctataatcccagcactttgggaggacaaggcaggtggatcacgaggtcaggagttcgtgaccagtagcctgcccaacatggcgaaacccatctctactaaaactacaaaaaattagccgggcgtgatggcgggcgcctgtaatcccagctactcgggagcccgagtcaggagaatcgcttgaacccgagatgcagaggttgcaataagctgagattgccaccactgcattccagcctgggcgacaagagtgaaactccacttccaagggaaaaaaaaaattctttacatagcttatcaaatacagtgttcaatatctacatgacgtactggacactgacacataccatttctcaataaagagctgacagccctctctccccattccctcagcatcgtttgggtatcttatgaaggacatgagttgttttagggatgtaatgaattccattcagcactatgaggtactctcaccgacaatcacagaagaattaaaactgactgaaaggcaatagatatgtttcccatttcaaagctcactgtggacattttcttatggtttggaatggttgtgagctgtccaaactatattttgatgtgtttttcttcttttgatcagggatcatagttcagtaaacccacagttaaactaagtgggctgatcgtatgggtctatctaaagtgaatttgtgtacttgtctcatccttcttattaatgagtggttctaaactggacttggtttttctcccatggggcatttggcaatgtctggaggcatttctgattgtcacagccggggattggggagggcagggtgaggcaaggggctattggcaggtagtgggtaaaggccaggaatgatgctaaacattctgcaatacacaggacagcccccaacaacaaataatgatctgggcccaaaagtagtggcaaggttgagaaaccctggcaacattatgtgtgtgctccccttgtgtagtgattcctttgtagtgtttgccttgacattagattaagtgttcccttaagcagaagctgaattttttgttattgagttgcagtgaaggatgggtgtgaatctctgcagggttaaacatttttacattaacctttcctttttatttttatcaaaagtaatatatggttacatgtatgtgtgcatgtgtgcacacacttatgcagaacttagaacagttccccacccattcttccctagttttatcgcatttcccagagttagcaacatgtaaagagttttgtttttaatttttttggtgattgcctctctaagtctaaataatagcttttggttatctattgatttaagagattatctattgactcttcactgcagaaggttagcaaaagctcagctacactaatccctccccttcttccttctaatattcattagtttatattcgattgtcctttcattgattattttgtaattctaaattaaatacatataaacatttaattttgttccatcaactttagtcagtatctttttatcttctgcctttattatactagcgcttctgttctttcaccttccttattcctatttcctatagtctgtctgctgtacctttacattgtcagattgacaatatttactttctgttttataattatatttgtttgtttttatccataggttgaagccaaaagttgaaaactattaccatttataggatataactgtaaatattgttcactgaagagctaagtagtatactgagatcccagaatcatctctatatatgcaatatcacatcctctgtgccatgagaaagaatgttcctagtattctagcattctgttttctgtgttgagtgttttaaaatcatgccacattcagttggcacactggcatctaaacacatactaagaaagatcagaagtgtcaatgaaattgcatagtgaatattcaaaaaatgaatgacctgcatgggcaaataatacaaaaaaaaaagatcagaggaaaatgatagaaaacacaagaaagacaagaatttcaaaataataagggtacattcccaatggccagctttctgagagttgaactgtatttgaataactcatgtccctcaacccagatccaaagataatattgctgctgctgaaacctgggctctttactatgaccagagtttattaattgtcctatttcattgaggaaaaaatgcaaaacagaacactggaatgactagctggaaatattccactatttcatgggaagcaggtttctaaacgattcctgtggaggccaaactcttgctctcgccaaaatattatagcattaaagtgtgccttgatggtacattaaggaagaaattttccccgaatttacttaagatttatagcctttctgctctcacaaaacgtagcattgatttctttaatatcaaaaaaagtttcctaaaataaactgctaatgattgctttcagtcatttgtttacttgaggtcagtcatgccaagtactgtttgtatcaattcttgtaaaagactcaattaattttgtaattgtcataattactgttattcctgttctgtaggaatatgctattaatgtaactggacatcaccacatcttatttttgtatctctcaaaacatctttcataaaactttgatggtaggaaagagctgaaaaaaaatctcctgttagtagaccaagtagtacttcaattactaaacaccagagaaaattaaaattacaccttaaataaaaccaaccagatatttggtagagaaaatggaactgtacaaaaatatggtttttaaaaataaaattctaccacttgtattatattcattatagactattggaaaccgttccctgccaaaaaaagaaagaaaaagaaaaaagtttgtgaccatttgtaattcattttagtctttttatgtatttttttcacctaaaataatatgggcatttaaatattttaaatatagttttaaatggctacatattattctatcaaaaatacctaccataatttatgtaaccactttctcattgttgagcatttaggttagttttgtttttccagttgaaacaataccccctgagtatctttgcatataatgatttctcttgattttagttttaagacaagctcttaggggtcaaatgttttaaatattttaaaggttcattgttcaaattgcatttcaacagtcaataccagtttacactgttttcagcattttaagaaattgcccaaatgacagagcagaattttaaaagtatttccctagtgttgatttggtttatatgctgagatgctgcagattttttgttgttaaaaagtgagtatgtggagatcaaacatttggctgactgtgtacacattttatttagtaaagcctcaatgttaagcaagaagccattactcatattcatgttgtctcaggaatggaaaagtgcttctaatttttgcaacaaaagaagtctgatggcagtgacagaaaggaatgactagctagatatgctgaccggaaagctagaattaggatttgaccattgtagtcagtctccatttaagagcctaatggttttttcttctcaatttggaagtttgctgcatttagagatattcttataaaactaaaaaaaatagacccagggagcaagtttgaggttactaaaatgtatcccattattgtcagagttgcatttcaaactgtcttcattaaactgttagtttgattacattttctcaaacagtaactgttgtgttttaattttttaaattaaaaataagttttaaatttcaggtaattgaaagaccaattctttttggaatctttcagtattatggttttggttcacagcgaaggtatttgcttgctacatttgctaaatatactatctatacttcattttgttgcataaaaataagacatactccggttagcctttttgatgggtattaccttgatgacttgctcactgacagagaaactgatgtaaaataggtcatttgaaaagcaggtgtttgatatatccccatatgtaacactgaaaagccttcttgctctagatttttggaaggaaagctttcttaagaaagaacggaaaagagagaagaaccaaatagacgcaataaaaaatgataaaggggttatcaccactgatcccacagaaatacaaactaccatcagagaatactacaaacacctctacgcaaataaactagaaaatctagaagaaatggataaattccttgacacatacaccctcccaacactaaaccaggaagaagttgaatctctgaatagaccaataacaggctctgaaattgtggcaataatcaatagcttaccaaccaaaaagaatccaggaccagatggattcgcagccgaattctaccagaggtacaaggaggaactggtaccgttccttctgaaactattccaatcaatagaaaaagagggaatcctccctaactcattgtatgaggccagcatcatcctgataccaaagccaggcagagacacaaccaaaaaagagaattttagaccaatatccttgatgaacatggatgcaaaaatcctcaataaaatactggcaaactgaatccagcagcacatcaaaaagcttatccaccatgatcaagtgggcttcatccctaggatgcaaggctggttcaatatacgcaaatcaataaatgtaatccagcatataaacagaaccaaagacaaaaaccacatgtttatctcaatagatgcagaaaaggcctttgacaaagttcagcccattcatgctaaaaacaataaattaggtattgatgggacgtatctccaaattagaagagctatctatgacaaacccacagccaatatcatactgaatgggcaaaaactggaagcattccctttgaaaactggcacaagacagggatgccctctctcaccactcctattcaacatagtgttggaagttctggccagggcaatcatgcaggagaaggaaataaaggatattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaagtacctaggaatccaacttagaagggatgtgaaggacctcttcaaggagaactacaaaccactgcttaatgaaataaaagaagatacaaagaaatggaagaacattccatgctcatgggtaggaagaatcaatatcatgaaaatcgccatactgcccaaggtaatttatagattcaatgccatccccatcaagctaccaatgactttcttcacagagttggaaaaaactaaagttcatatggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcatatctacacctatctgatctttgacaaacctgagaaaaacaagcaatggggaagggattccctatttaataaatggtgctgggaaaactggctagccatatgtagaaagctgaaactggatcccttccttacaccttatacaaaaattaattcaagatggattaaagacttaaacattagatctaaaaccataaaaaccctagaagaaaacttaggcattaccattgaggacataggcatgggcaaggacttcgtgtctaaaacatcaaaagcaatggcaacaaaagccaaaattgacaaatgagatctaattaaactaaagagcttcttcacagcaaaagaaactaccatcagagtgaacaggcaacctacaaaatgggagaaaattttcacaacctactcatctgacaaagggctaatatctagaatctacaatgaactcaaacaaatttacaggaaaaaaacaaccccatcaaaaagtgggcgaaggacatgaacagatacttctcaaaagaagacatttatgcagccaaaaaacacatgaaaaaatgctcaccatcactggccatcagagaaatgcaaatcaaaaccacaatgagataccatctcacaccagttagaatggcagtcattaaaaagtcaggaaacaacaggtgctggagaggatgtggagaaatagaaacacttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaagccaaatgtccaacaatgatagagtggattaagaaaatgtggcacatatacaccatggaatactatgcagccataaaaaatgatgagttcatgtcctttgtagggacatggatgaaattggaaatcatcattctcagcaaactatcccaaggacaaaaaaccaaacaccacatgttcttactcataggtgggaattgaacaatgagaacacatggacgcaggaaggggaacatcacactctgaggactgttgtggggtgggaggaagggagagggatagcattaggagatatacctaatgctaaatgacgagttaatgggtgcagcacaccagcgtggcacatgtatacatatgtatctaaccttcacattgtgcacatgtaccctaaaactttaataataataaaataaaataaaataaaagaacagaccagatgcagtggctcacaccagtaatcccagcactttgtgaggccaaggtaggaggatggcttgagtccaagagtttgagattaacctgggcaacatagtgaaaccctgcctatacaaaaagtaaaaaatgaaaagttagcctgggcctggtgtatttgcatgtgcctgtggtcccagcaactccaggggctgaggcaggaggattgcttgagcccagtagttcaaggctgcagtgagctgtgattgtgccagtgcactctagcttgggttacagagtaagaccctgtctcaaaaaaataagaatgtacatatttaattgtaatatgaaacggatgctgaaaatgaacaccgatataagtgacatatcagagatgctctggagacttggttcatataatatggaacaaaattaccttctcaatgccaaattagaaaatgatatgtacataattttcaggtttaaaatatatataccaaggctttgggatgttaaatataaggaatgttgcccatgtataacattatcaattaagcttaagaatattaaagatttgttgattaaaataattactaatttttgtgatagcttttactttagaatatgtgatttgaaaaaaaagaatgttgacatttcacatagttggaaaaaattctagttcttagttttgtaacttaattttatgttctaaaatatgtctcaaatccacccttgtaaaattattagtcttttattattaaagcataaagtttgctactcataaatcaaattatatatctcaaattcaaagctaaattgcccttgtgcattgtttagcagtatgtaaatacattttagaaaagggctgtatcattcatgaagtttccaaattcgttgatcaattctgataataaagttaaaatttttgttcttaattagtagatctcattattttttcagcattccactgacttctttctaactttgtagtaatgataggtaaagactgtatctggcttaaaaaatgcttatttttacatacatgtaggtctttgattatgaaagtaccgaggagttcttttgtttatacagtggcagttgaaagaaaacccatgtatatcttgagaagatttattggaactagctttgagaaatgatgagccatatctttaactcaataaaagatatgtattgctgtaccaagccttggtatctgctattctctttagtgtaagcacttttcaaactataggattatacaaatagtagcatcactagttaaaacataaagctatatgatctaaagacatagttttggttattttttgagccatttaattttcatcttttctgtgaccacatttattaaacatgtgacatgaaaatggaatactcttttatgatgacaaaagaaagtatatgcccagccaattatgggataagagtattattttttgtgaacacattatcatcattctagacacctggagaagtgaatatctctgaaagtatcatacatttatactttaactttatttacatatccagttttcagaaaccattgccaatgaaacatttggacaatgtggtatgcaagtactgtatagtaagaagtagggatgttcttgagtaattgttccatttgaattaatccagcatgggtagttgttagacaaccatgaaatgtgctaagctttacctattctaagaggactctattcttacagaccataagcgttcaaaagttttccaagaaaaaaaggttacttctttaaatttagtctgcccattcaaaagctacaataaggcaggtggattaaactgctaggagttgcaatgttagtattgagagcatttaagcaatttaaaatctttcagaatgcctaagatcacaaatttacccctgatcagcctacacagattaacttaaaatacatacagagagatgtcagatagctagagggtcataaattagtgaccaaaattacatcaatctgcatgttgacattgtttaccttatattgattagaaacttttgcttaggaaaaaggggaaataacttttattttaaattatactttaagttctagggtacatgtacacaacgtgcaggtttgttacatatggatacatgtgccatgttggcgtgccgcacccattaactcatcatttagcattaggtatatctcctaatgctatccctccccctcccccaccccacagcagggatgtgtgatattccccttcctgtgcccatgtgttctcattgttcaactcccacctatgagtgagaacatgtggtgtttggttttttgtccttgggatagtttgctgagaatgatggtttccaatttcatccatgtccctacaaaggacatgcactcatcattttttatggctgcatagtattccatggtgtatatgtgccacattttcttaatccagtctatcattgttggacatttaggttggttccaagtctttgctattgtgaatagtgccacagtaaacatacgtgtgcctttgtctttatagaagcatgatttatgttcctttgggtatatacccagtaatgggatggctgggtcaaatggtatttctagttctagatccctgaggaatcaccacactgacttccacaatggttgaactagtttacagtcccaccaacagtgtaaaagtgttcctatttttccacatcctctccagcacctgttgtttcctaactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatatccttcgcccacttgttgatgcggttgtttttttcttgtaaatttgtttgagttcattgtagattctggatattagccctttgtcagaagagtaggttgcaaaaattttctcccattttgtaggttgcctgttcactctgatggtagtttcttttgctgtgcagaagctctttagtttaattagatcccatttgtcaattttggcttttgctgccattgcttttggtgttttagacacgaagtccttaacagcccatgcctatgtcctgaatggtattgcctaggttttcttctatggtttttatggttttaggtctaacatttaagtctttaatccatcttgaattaatttttgtataaagcgtaaggaagggatccaagttcacctttctacatatggctagccagttttcccagcaccatttattaaatagggaatcctttccccatttcctgtttttctcaggtttgtcaaagttcagatagttgtagatatgcgacattatttctgagggctctgttgtgttccattggtatatatatctgttttggtaccagtaccgtgctgttttggttactgtagcctcgtagtatagtttgaagtcaggtagcgtgatgcctccagctttgttcttttggcttaggattgatttggcaatgcgggctctttttcagttccatatgaactttaaagtagttttttccaattctgtgaagaaagtcattggtagctcgttggggatggcattgaatctataaattaccttgggcagtatggccattttcacgacattgattcttcctacccatgcgcatggaatgttcttccatttgtttgtatcttcttttatttcattgagcagtggtttgtagttcttgaagaggtccttcacatcccttctaagttggattcctaggtattttattctctttgaagcaatggtcaatgggaattcactcatgatttggctctctgtttgtctgttattggtatataggaatgcatgtgatttttacacattgattttgtatcctgagactttgctgaagttgcctatcagcttaaggagattttgggccgagatggtggggttttcgagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaatgggctgttgaattttgccaaaggccttttctgcatctattgagataatcatgtggtttttgtctttggctctgtttatatgctggattacatttattgatttgcgtatgttgaaccagccttccatcccagggatgaagccgacttgattatggtggataagctttttgatgtgctgctggattcagtttgccagtattttattgaggatttttgcatcgatgttcatcagggatattggtctaaaattctctttttttggttgtgtctctgccagactttggtatcaggataatgctggcctcatacaatgagttagggaggattccctctttttctattgattggaatagtttcagaaggaatggtaccagctcctccttgtacctctggtaaaattcggctgtgattgcatctggtcctggactttttttggttggtaggctattaattattgcctcaatttcagagcctgttattggtctattcagagattcaacttcttcctggtttagtgttgggagggtgtatgtgtcaaggaatttatccatttcttctagattttctagtttatttgcatagaggtgtttatagtattctctgattgtagtttgtatttctgtgggatcggtggtgatatcccctttatcattttttattgcatctatttgattcttctctcttttcttctgtattagtcttgctagcggtctatcaattttgttgatctgttcaaaaaagcagcttctggattcattgatttttttgcagggttttttgtgtctctatttccttcagttctgctctgatcttagttatttcttgccttctgctagcttttgaatgtgtttgctcttgcttctctagttcttttattgtgatgttagggtgtcaattttagatctttcctgctttctcttgtgggcattttgtcctataaagttccctctacacactgctttgaatgtgtcccagagattctggtatgttgtgtctttgttcttgttgatttgaaagaatgtctttatttctgccttcatttcattatttacccagtagtcattcaggagcaggttgttcagttgccatgtagttgagcggtgttgagttagtttcttaatcctgagttctagtttgattgcactgtggtctgagagacagtttgttatcatttctgctcttttacatttgctgaagagtgctttacttccaactatgtggtcagttttggaataggtgtggtgtggtgctgaaaagaatgtgtattctgttgatttgggttggagagttctgtagatgtctattaggtccacttggtgcagagctgagttcaattcctggagatccttgttaactttctgtctcgtggatctgtctaatgttaacagtggggtgttaaagtctcccattattattgtgtgggagtctaagtctctttgtaggtctctaaggacttgctttatgaatctgggtgctcctgtattgggtgcatatatatttaggatagttagctcttcttgttgaattgatccctttaccattatgtaatggccttctttgtctctttttatctttgttggtttaaagtctattttatcagagactaggattgcaacccctgcctttttttgttttccgtttgcttggtagatcttcctccatccctttattttgagcctatgtgtgtctctgcacatgagatgggtctgctgaatacagcacactgatgggtcttgactctttatccaatttgccagtctgtgtcttttaattggagtatttagcccatatacatttaaggttagtattgttatgtgtgaatttgatcctgtcgttatgatgttagctggttattttgctcgttagttgatgcagtttcttcctagccttgatggtcttcacaatttggcatgtttttgcagtgactggtactggttgttcctttccatgtttagtgcttccttcaggagctcttgtagggcgggtctggtgatgacaaaatctctcagcatttgcttgtctgtaaaggattttatttctccttcacttatgaagcttagtttggctggatattaaattctgggttgaaaattcttttctttaagaatgttgaatattggcccccaatgtcttctggcttgtgaagtttctgccaagagatcagctgttagtctgatgggcttcccattgtgggtaacccgactttctctctggctgcccttaacattttttccttcatttcaactttggtgaatctgacaattatatgttttggagttgctcttctcgtggagtatgttagtggcgttctctgtatttcctgaatgtgaatgttggcctgccttgctaggctggggaagttctcctggataatatgctgcagagtgttttccaacttagttccattctccctatcactttcaggtacaccaatcagacgtagatttggtcttttcacatagtcccatatttcttggaggctttgttcatttctttttattcttttttctctaaacttctcttctcgcttcatttcattcatttgatctttcatcactgatagcctttcttccagttgattgaatcggctactgaggcttgtgcattcatcacgtagttctcgtgccgtggttttcagctccatcaggtcctttagggacttctctgcattggttattctagttagccattcgtctaattttttttcaaggtttttaacttctttgccatgggttcgaacttcctcctttagcttggagtagtttgatcttctgaagccttcttctctcaactcgtcaaagtcattctccatccagctttgttccattgatggtgaggagctgctttcctttggaggaacagaggtgctctgatttttagagtttccagtttttctgctctgttttttccccatctttgttgttttatctacctttggtctttgatgatggtgacgtacaggtggggttttggtgtggatgtcctttctgtttgttagttttccttctaacagttaggaccctcagctgcaggtctgttggagtttactggaagtccactccagaccctttttgtctgggtatcagcagcagaggctgcagaacagcggatattggtgaacagcaaatgttgctgcctgatcgttcctctggaagttttgtctcagaggagtacccggccgtgtgaggtgtcagtctgcccctacaggggggtgcctcccagttaggctcctcgggggtcagggacccacttgaggaggcattctgtcccttctcagatctccagctgcgtgctgggagaaccactactctcatcaaagctgtcagacagagacatttaagtctggacaggtttctctgccttttgtttggctatgccctgcccctagaggtggagtctacagaggcacgcagggctccttgagctgtggtgggctccacccagttcgagcttccagtccactttctttacctattgaagcctcggcaatggcagcgcccatcccccagcctcgctgcagccttgcagtttgatctcagactgctgtgctagcaatgagcgaggctccgtgggcataggaccctccgagccaggtgcgggatataatctcctggtgtaccatttgctaagaccattggaaaagcgcagtattagggtgggagtgacccgattttccaggtgccggctgtcatccctttctttgactaggaaagggaattccctgaccccttgcacttcccaggtgaggtgatgcctcaccctgcttcggctcatgctcggttcactgcacccactgtcctgcacccactgtccaacactccccagtgagatgaacccggtacctcagttggaaatgcagaaatcacccatcttctgtgtccggaaataacttttaatatgtacagcttgagagaaagaatctttcagaaatgagatagagaaacataataaaagaatccttggtgattttcttaaaaagtaaaaaccgtcactactgagaaaaagacatgttttacaaagacatctgaaaatcataggtattgtggcttatgttttgggatggaaatgaaagatttgatgaaaattaccagagatttttacataaaacagctgattaaagccaaccatcctttttagtgttgcctttatttgaggatgttagggagaattttctcattttgtgtttagtcctgattggcctggatcataagaattatactgtatttagtttgtagtaggacctgctcttctctttaggacctgacacataaatagttttgtgtaaaagtgaacattgtaatttctcttaacagctgtaacatcttatgaagatcttggactctttgcatttggattacctggaaaggtaattttttttcctcctcattgtgtccaaaacccaaagtggcatttttccttttgtttcaagttaaaagagacaagtatatacaagaggaagacattagaggaataaaaggaaactaaagtgagaaaagagagaatgataggagcaggcaaagaaagagaagtctttgtgtccttcctaaaaatgcatcaatacatttaattcaatgcttgaatcttttaatatttttcatcctaataaagtagcacaatgacttgaatgactttaaaagagtaacgatgacctgttttaagttgtattaattttgattatgtactcatatgagtaaaccctcataaagacaagaaaagaaaagcaacatcgaattcaaattgtagcatggctatttacaaaaccagtaatcagaagatcatatcacttaagaattgaacattgctacaagattatctagctatcctctcatttataggtgaggaaattaaggaccagagaaattaagggacctatttgtcaactattatataaagccagtaccacatcctagaactctagatctactgcttttcttactcagaataagagaaataacagcagtatttatggggcacccacttgcaatagggatactacactagtttaataggtagagaaaaataattgtcttccaccagtaatcaggagttgaacgttactgttagtgctatagtatatatattttttaatttctgaagaactactatacttctaaaattcatattcattttggctccaaacaggaattcttttgtttgtaaatctgttgtttgtgtttttatgttttcgattgacaaatacaaattgtatatatttattatggacaacatgtcattttgaaatatgtaaacattgtagaatggctaaattgacctaattaatatttgcattacttcacatacttaccattttttgttttatttttattctaaaaggatactctatctgtaactggctaaactaacttctgaaagtgagtctggaggaaatatatatagctatacaatggaaagaaaacctgtatttacattccagttaactttggtggagttttttgtttttgttttttcagacagagtttcgctcttgttgcccaggctggagtgaaatggcatgatctcagctcaccacaacctccgcctccctggttcaagcgattctcctgcctcagcctcctaagtagctaggattacaggcatgtgtcaccaggcctggctaattttgtatttttagtagagacagatttctctatgttggtcaggctggtctgggcctcccgacctcaggtgatccacctgcctcggcctcccaacgtgctgggattacagcgttagccaccgcgcccggccctaactttgtttttaaagtacaaaaaggaatgcttaaatcatatactatatagcatcatggcttggaccttagtcacctgaaacttaaacaaaacagaatatgttacttgagggtaaaaggttttgttaatcttccttagtagcaatgtttctgttctagaggattaggatgtttggtgtagccagggatcagtttcctccatctagtttaaacaaagaagaaaatattttttgtatgagaaaattccacaattaatataacataacctataaacataactctaagtatcaacactgacatcactgtcatttcatgttcatatttcctgcgttgcttgtatagcagcaaagtttaaagagtagggactgctgagagtcttcttttcctaaacctcttagagtagttgtgttgtcattttaatacatgcaccaaaaaagttcatagtaggcaggaacactagacaaagcatactctgaatgaggagttgttgtttggttgcttgtttaaattttctccacacttccacagttgggttgaaacttaaccatttccttctatccagatgttatatagttataatatgggataatattatgataaagaaattttttgaaatgttttgaacttgttaaagatttatttcaatgtctataaattggtatttattcaccagacaaatatttattgatcaaatactttgtaccatgtactgtgctaggcattaaaaatataagtaggtaggcaggtgggtagatagatagatattctagctttcaagatattaaatgcttaaattcagccaaagaatgaaagaataatcatcaataagttaatattactgttttttgcaatatattaattgaaaataaaaccaaatttcatgtatacctactactgacagtaggtatcatttgtactgaagatagtatacacaagttcaaaatagtcttttcacaaataacttcgacattttggaactaagttttacataggctgaaatgcagaattttttctggagagcgttcaagtggcaatcaccacatctccaaagacactttgccagattttcatatcattagccctcctctgcaaacctcaaggctcctaggtcctaataacttagattgttttcagtgtaggcaaatgctgtgccactgatagaattcctaacaaagatgggcatgaaagattatctgttcccaattcatgtagaactgaatgattctagacagctagtcagctccaggcatacgttggggttccgatccattaagacttgagtgattgaaaggcccacatggaagcacagtgttttactgtttcctctaagcatatctgattaccttgagttccccaggaatctcatcaaagatgataagctaacaagcctacagactgaatttagtcctcaggcacattttatatggctcaaatattttttatttttaactgattaccaactaagcatcattaaagtatgaaaaaatttcatttctgactttctttgaaaaatcagatctggctacattggatccacattctcacatattatcaactggccagagctgagtagcacctgccccattgaagggggaggaattctccaatatcctacagttcttgccaactcccattgtcttatattcagcttaattcacattattgagtttggaacattttgcctatattttcagggtttgagagtaattgggctctagactttattaatctctgggactgggatgctcaaagtctgggatgctgatatagtcagaaaacttatatcatttccttttaggcaatatagcattggcatagcacacccagccggtctttttctacttatttaagcagtgtgataaaaccagcaagaagggaatgagacaccactcccacacttttaatttttatacttgataatcatcgattactagcttttaacacttttaacaatttaaaagtgactgccaagaaaaatttcaaaaacttctttatagtaactttggaactattaaagaaatactttttaatgtgatgattattaattttatgtatttcaaatgactggcagatttctttttagtttctcctcacaacttctgcatctgcttttttagtaatagttactggattttaataaaatactgatccttttatattgtttccccttctatcttctgaatatttctgttcttttacagttggtggtggcaggcaccataataattcagaatattggaggtaagcaattgcaagtgcactgtttatacataaatgtgatggcaataatgtcctttgaattgttatcttactacagatctagctgggaacttctgtagacatagctatcttcagaagcctgtgtgttggcctctttactctttttttttttggatcctttttagcagcacttgtgacagtagcttctaaattcagtttgagctaaaccctgattgcagtcgtgttattaggtctgcaacacacctctaaaacattggctttctgtgattctgaaggtaggatacagtctggaaaagctctcctggtgattttaaaatattttccctctacttttgttctaatcaccctattggcagatactactttagagggattagtgttccgtgggctgtgaacaagcaagtatggacaacagtgtcctcttgtaaccaagaatttaaaatgaccaagtggtttaaaacataaataaatctgagataaataagcattctcacatttatcctgtatcttgttcctattaataaccaattctagaaatgatctcaatattgagaactatgtagaaataaaactactgttaattatagacagttactgagtaaatgtattaaacatttaaatccaaaatatgggtatcatgtgtgtatatgttgtaaagaagttgcgtagtgctgaacaatatcttcgttttcttttatcattgactggagtgctaaataaatgctcttaaaggaaaatacacagaaaagtttgacatgtactttggatcttatacaggattgtatagtcagaggacattttaatcttattttttacatgtaacagtttaattcaaagatgacagttttaataaacttcagctctcataatcaagaggtctgagctatatcactttaagtattgttcaatcaaattccatcgttaataggtttttttggttaaggaaaaattgacattccaccagtgaattgtgctgccattgttttagaatcctgttttaattctttgaattttcatgaaaaaatatgaataaaaagaatgctttcttgcatgccataccaaataattttctcctaacacacactacttcacacttcacagtagaaagtcaagaaaaccagtctcttcatttatgaatttattatagtcattgattttaagatctattttggaataatttatttagcaactaagtattgcttaactgtgcactgataatgtttctgaatatgatgtatatttttatatttttaatccctctttatcctctctgtatagattctaagaactatcacatattgtttaggttagattgaaccattgtttaacagtttatgtagactgttcagttcagcaatttagatccaaatttgtgaccctggcacaaggcccactgttgtattctttgtccctttcaccttgattccttccttgttctctaatcttgtttataactgttattggagatggctatactgtagcacttggctgctactagatttaacttctctgtatgtatgctcctgtaccccactatattgttaagttcctttagctcaaaagtatgcctcatttctctttgtactcccagcacctattacacctgggaattgataaacttgttgagcagaatagagctgaaatgatttgtataatctctttctaagtaccttaaatattctagatatatttatcaagaagagaaaagggaaatgctagaccggcatctagcttcaggtatttgaaagactgaacatgaaatataaaaaagacactagactaattcaagtattgttccagagggcagaactggtgctaatgtatagaaatctacagagaagctgttttgggttttcttattcggagtacccttgtaactaagctgtgtgataatgaggatggcctacatccctttgaaaatgctccttagccctgaaaacattcaaacagagctggttggtcagttgccagaattctagaaaggattcttgcatttggaggtggataaatcatgagttttcccaactcttaattttgttggtttgcttgcttgcttattttagaacttttttttaaaaaggtgatttagagtggtcacagcagtttttaatgtcccttaaatttagaaaagctagtaatgcttatttagtttttagaatgatatcctcatgattttcttcacattggttaaaagtgtattaagtgcccagtcagtaataaccaaatacatattttcagagttttttctgtcttttttcgtagccagatgtacataaaccatttctttattataatagaattggaagcttgctcttgtgagcagaacactagattggaagtcagataccttgaattctgtctactccagtctctgccattgggtagccatgtgtcttgtggaaatccctcactctcactgtcttggcttcagttccctctttgttaaattgttggacggtagagtgggaagcagggagtttaaggtcccttcttaccccaaaatttgaattcaaatttggcacattgggaggcatattaattattttaacgtattaacgtattttattacaggaaagttcaatgcgagggttatacttggttcaaaagatgatttggccctttcttaggtatctttaacaaatcaataactattgccctaaaagcattcatggatgctattttttgtcactaagcaaaagggaacttcagttcttaggactaccctttagaacctcctcttaggttaaagtctaggaaccctagccttaaaaagtagtttcttgattgatatatacagaatctgtggaacttctagtccatgtatgcttgcaaacaacatacttatttgggaggatatttaatatactgtgtcattatattaaataagtatatatatatatatacagttttattataataaataagttaatcgtacaatgaccaatgttacttcattaaaatggattttgattattttctttattaattggaaatatattggatatttaaaagattatattaagtgtaaatcagattgaatttttacacatcttaagtgcctgtctgcaaataatgtagttcagataacttttttttaaaagaatgtttgttagtataaattatctgacttttgcagtggttgtttacattaaaactgaaaaataatgtaatagattctatttaggtcaagcactctactagatactttaattataacaactcttcaatatagatattatcttcattttatagagaagagatcagtgtgcagtggagataagtagcttgctcacatttatcccataatgaagcttggattcaaaccttgctcagttggcctttattctttctgctatgatatagcaaatgtttgaaaaatgtgaaaagattaaatgttgaagattttctaacttcttggggacaggaactatgtgtttttatttgttttcctaactttacctagtttctgagaagagctcaataagtagtatttgttgaatgaattggacagtttttaaagttctgcttaaaagcctaagattttgcctcaaagagacaattgaatatactatgtaagtgataaaaaaagaaacttgaaagaccatagaatgacttctagtttagaattatataaaaatttaaaagttcaaaatactggggagagttagatctcatttatgtaaaatgggttaacaatatattgaaataggctgggtgtggaggcccacgcctgtaagcctagcactttgggaggccaaagtgggaggattgcctgagctcaggagtttgagaccagcctgggcaacatggtgaaacccagtctctactaaaaatacaaaaaattagccaggcttggggttgtgtgcctgtaagtcccagctactcaggtggctgaggcaggaaaatcgtttaaacccggtagacggaggttgcagtaagccaagatctcgccactgaactccaacctgggcaactgtctcaaaaataataataataataataataataatatatatatatacacacacacacacacacatatatgtaaaatatctattattttcaggttaagaaaatcatatcttaatgtttcttaactctcttattctttgtaacatttaaatacttctcagttttcatgagatacaattcctgtggtgaatccatgaaaaaaattgaaatggaaggcctttaaaagcaaaatgaccatggattgcccttgatcaatatttgtttcatgtgtctttcgccaaagacccagtttatttcccacatttccatattccataaatcaaattaatgtgctcatttatttacatccctagtacttagcacatagtatacatttagtaaataacatttattataggaagaaagaaaggactaagaggggagagggggaaaagctagtgacctggcttagtactccttcaagagcaaaaagagagttgattgaccaggaagagaaagcccagtatatgtaagtgagcatatagtttttaggaaagcgtctactgttagaacttcacagaaaatcgtttttctcccccaagattaatcaggcaccaagtattagtcacaaggctctagtgtggtctgacaaattgattgaaaaaatctactgtctgtaaatctctaaattttataatggaaaaaaatgcaacacactagatttaacactcttattctaaggttatagaaatccttggctttggaaatttgggaaccatatagtaaattactacttaaaagcaattcctgatatcttcccaatactaatgaataacaggctcaacattggctagagccagaggtaaccctctgcagcccatttcctcaggtgctggagtagcatttgttgagagccactgctactgggacccaaagtcagaaaagatgtgtctggaagttttaacatttaatgctgttataggggacaattctggcttagagagtttgaatttggcagcctaactaaagataaaagattaataactgtagtagaaagtaagtataaggtagttttcacatagttcctgtaacagtgttgtattatgtgattcttttcttaaaaactaaggtaagtagttggtttcacattcatttgaactcctgaagtaaaccattcagtaggctagaattatcactagaaatcaaacactacatcccaatcatcttcttagtcaagccagaaaaagtcttattaactcttacaagcacatgataacagtgaagtcaattgatgttatttctggtttcacaacttgcccaattcaaaatgtggaaagatgagtagctcctagggggatgttatattcttattttgctcttataaatatgaaggattactatgaatagcatatgctttccttaattcttcaaagccccagttctttaaaggagattaaaaatttaatcattactacgttttgtgaaaggaaaaccataaacattagtagtcttactgaaacctcctgaaattgctagaatgacccagatgtttcagtctggcacagaatccacacaccttactcttgcagcctttattaacacctcagtttggtaatctatggactcgggtaaccccatttctaaatctcagaaaggtataaataagatcattttcaattgagaattataaaaatctcaaattctcagtatttgaaaaattcacaatattagatgctagaaactacttggatttgctttcttcctgtatattcattcatgcattttatttatttactttttggtaggctagtaaagtactaagagtgtttcagatatactagtttgtattgtctcttgggaaactaggattgggcgcgcagatacatcgccatctgctggtcagtttatctgtggtgaaactgcagctttcttgagacttgtctagaaattctagaaagcactgccttagaataggagaggtacaggaaatttggagagtctttttcacaagcacttcatttgacaacatttactggtagtgtatcttttttaaggttttgaaaatatttttcatagtaatttctattgaaaattataaaattttcagaacagtagatattttggtcattttttaatcaaatttaagatcctgaaaatgataagacaaagatatacatttttttctagggtcatgggggagcattttcccccatatattttgattttcatttatgcatgtgttctgtactatttgagtgcatatagaacttcagtggcatttagatattttgtgggaccaccagattaatgagacacattgaatagaataaaccagttagtatccatgactaaaaacatgtttgaaataaaattgaatctctctgagacagaaaggcaaacttattttttccccgtagcacatccgtttgtttagggctgagtaatcctttaagaattgctgaacttcccccaagtgctgaaaacctaattctgttttaaaaatagctgtaagtaattctgtcctcatacatatattttacatgtttaacaaaaaagattcttatcttcataaactgtaatgatgtcttaggcccaaactccaattagggttggtttgttttttttaagtttgtatgcttaataacgacaacttgggaagcattttcagagtgctgcgaaaaataactcataagaatacagtatttggaagcacagagactgatttttattttttggatttcagtggagtgttaatatttcaaatacgtgagaataggaaacttcctcttcagaactacaatcacagccgtaaatacagtagagtcatagcagtagatgcaatagaatctcatcatgaaactccatgaattttgaactaatcacatcaccaaaggagctccaatactgaaaaatgaaatacattgaaaatatatctcaagatgaaatgaaaattctaagtgttactaaagcttctgactaatgttctctgtgatattcatttcctttgaagtcaactgttaatctcagcattcaaaagtagtttgtttaaatactgatttaaaaaagaaaaataattctgaagagtggtacttctggtagactttccttatttgtctttgttttgttggtttactttttcactttgctcctgcactttctcatggcatactagttaatagaacgagtttctcaacccaggcgggctgtttgcaccatcactagcttgggcaagttacttctttgtgcttccttatattctgtgaaataagtaatatgtacctcacaggtttgtgtaaagattaagtgaggaaataacttgtgtagaatactaccaagcatacagtaggcatctaaaaaacaaagatgttagctgttttcatggatctctgcccagagtcccttccctgtttctgtgtttctaacatctctcctctcaacctcccgggcccaattcatttatttcactttataattagatcagcagatattaacaccttgcaacttgctattacctaatcagattttaccccattttagtcactttttaatattactgttgcttctccatgttgtttttaaagagtgctttcaacttctgtgttttcagttgacagatgttttattttttcccagagaagtttctattaaatgagttatattagtttaaaattaagtagaaaagaatacctatttagttaatgtgctaaaactaagtgatttataatggctgaatacctgacatcaaggtatatcttctggcactgattttggctttggtggtttggggccacttaactatatgcatggctcttgtggatgacccagttgcagctattaatttagagtagaacatggtgtgtcttgttttaggaatctatactaggtgtccatgtcacccaaaatcatttgcaaatttttgcttatgattggtctgtaagataagtgcttaaacactttcttatgccatttataaaagacataagacaaaaactgtggcagacagctatttgatctagtaaaccttttagttaaaaacaaaggcaatatgagcattcctatcaatagtatatctttaaaacttttccagttcattttattgagctgattgttcttttgtatgaatttaattaagatatatttcctaacttaatgtgtatttggtaatctttttgtttcttttctgtattatatataatataatgtgttaaagtgctagctagttcttacatgaaagtttacttgtgattaagaaaaaaataattttcatagtgaatagaatggtggtggcctttgttttactggcttaatccgtgtgggttttcccctatagtaagttctgtggttgtatactcttaaaatatatactaacattctctagaaaagaagcaatgttttgcatgttttattatatttgtatcttgtatgtgaggtcttctttgagagagaaacacgtttggtgagttcatatttcttaaaatatacatgattcttcagactggaatctaatgaaatagtactcccatttgaaaaccaaagagttgagggtacaacaaaggataaaagtgatcagatgattagccaggggctaatagaaattctggaaagaatgacagatattatattagaaagaaataggatctcatattcactgaagctttctacagctaaaggtccaaaagaaataatagaaaattactgaaagagatgaatgtctgaaactttagaaatgcatgtggtgttggattaatccaagcaagaaagaaagatgggcagataataaattacattttataggaagtctgctttccttgttttcaaagtattttgtcttttttcttttctgtctctctcacaagatatatttaagtaagtctaggccggtttcagaaaattcagttcacaatttttatctttgcaccatatgtgtagagttctttggaatcggtaaaatattataaaaactccaaatccttgaatggagaaggttagtctaaaccttccttctgttctgtgccaaattgatagcatttttccttacgagaatatgaacaatacagaacacattttcacatacaatcagttgtaataccccataactaaaagattttgcagaaatgtctcagtggattttagtcaacccactgagacatagctgtacttctgctagggaaaaagaaatcgttgtaaactgaaaaaatatgtatatgtatattttcatcacagagaagtgattatttaactgttctaaattttactttgacataaatacatgttattttactaaaaaaaattgagagtgtatgtttttgtgtctatagtattatctatctccatacaaatttacacgcaaagtagcatgtatcctttttttcctcaagttaaatggtcacatagcattgtaatcatgaagttcagctcctttcaaatgatgttgattgagaaatatacattcttcttaaactatttgagccttttaatcaatttttccccagatttttgccattgaaacttgactttcatttttgttcttagcttttgtaagttttgtaaggagaaagtgaaatgtttcctgatatataaataagtaataaaattaatgtgcacacaaagtatactctttattcttttttttttttttttttgaggtggaattttgctctttcacccaggctgaagtgcagtggtgcagtctcggctcactgcaacctccgccttccagtttcaagcgattctcctgcctcagcctcccaggttagctggtattgcaggcaactgccaccacgcctggctaatttttgtattttcagtagagacaggatttcaccatgttggccaggctggtctcgaactcctgacctcgtcaaccgcccgccttggcctcccaaacactctttgttcttcatgggcgtttcctttttggccccaacacatacacacaaacataatctctgggaggaaagagaatcttactctgttaaattgaagttctgactacaaatcttctgagtttctatatatttaagcttaaactcaagtatttacatatgaatgagttctgtattctgtaaccatattaaaacttttcctagtatttttatagaatttgtttttatagctacatcagaattaggatcgttattaaagtgctataaaaggtagttatttatcggactctgttagattaaatgtgagaaataatgctagcttcaggttatgattacataatatagatgaaccctgttaataaaatggaataaaagttggaagttttgtctttttaatatatttaatggtttatattgaactttctctaatctttttagagactaattttaaatgtaattcattatgtattcttttttatcctataattatatgtgttcataatgcaggggtgggtagtagagagaggaaaagaaagggacagagggaatgagacttctctgttgtggggaggcatctttctctagtaagaaggaacagataatccagttactagccatacctattaaacttctgtgtctatgtctgttgttgctaaactaacctctaatgccttagacggagtgataacatataagagagtttttgtaaaactttgtacaaaatttcatttaaaagtagcctgtaatcaagactgtttctcttacctagtttgctttggacttgaaatgtaaacaaaagatacttaatgaacttaacaattgttattcttctctacagttacttttctgtgtgtgtgtgtgtgtgtgtgtgtgtgtgtgtgtgtatgtatctttggtatagtgtgttatatgttaatcttccatatgttgtcatagctctaatggacatctcttttcctagatggattattgtttaaatggttaagaatcatagaattctaataggaacactatttattcttttgcagctatgtcatcttatcttttaattattaaaacagagcttcctgctgctattgcagaatttttgactggagactatagtaggtaagaaaaagtattttacattgtgtccgttcatgtattaatttgataaatatgtattaagctgtaaatggcaatacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattgtttcatttcctgtttttgaacaatattataaacaatactaaactacattgtatctcttttatctttctttaaaaaatgcatcttacatttttgactcacctctttatagggaaaaaacaaaattaattgtacttttcactgtgtagaacaagaacattctagaaaaaggaacttgaaaagacagaataaatcattttaattgccatcaagttatttcacatagttaagtttcaaaccacagtacaaaacctgtcagacttttagatttgaatactgggttgttctgcttcaataattgaacttgttctggaatgcaaggaaaggtttcaaaaattagtttttagcttttacatttcagcttccattaaagaattctacttagacaactgcaaatacatatttgtaagaaaagtgtggtgtactttagatctgaatagaaaccatcaagaaaatgtagttaaaaaaagacaagtagaagtcctaaatgatttctcttcatcagaagatattgttcctttgtatgatactttacagttaatgaggtttccacatgcattatcacatctgatactcaaaactaccttattttatctacagctttatctagttacattttgattttatgcttaggttgataaacaattcctataagaaatagctatgtgaaattcatttttgtatctgctgtaaaaaacattgagggcaccttctattactcaaattctatgtgagaaatttatattttagggttaagaactcaaggcaatatgaggtagaataaagagggctagactaagagtaaggagatatgtgttctatccatttaatattcaataatctcaggaacttaatttaacttcttttgactatataaagtacttggagccttaggtttttttatgtgatataatgggggtaccaatattgccttctcaataaagttgctgggatgatcaagtaagatatatatacacatgctaatagcatgtgtataaacaagcatgtgtgtacacaaacttacagcacagtgtggagaattaaggaattctaataattactatattaaacgtggtgtttccctttttgccctgactgccaggaagctcagagtcaaatgtgacacatttgaattaatataactgtgttaattccaacagttgtcacaagtgttttcttttttcttgatcctgaatttggtggctcctatttatattcttttattgtcatatgtcggtggaaagaggagggattagaaatatatgtaatattttagaaataattaaagtagtatgtggcagaactggtattgaaatttaggtcttctttctctaaaagtgatatttttaccgtagcttcattttaaataattggcaaatgatttacattgttgcattgatttttttgttttttaaataaaaattaaaatgaacttccatctcattcatattaatagaaaattgattaaaatgttatttttacatgttagaaatacatttttaaaatcatatacttcaaaatactgtggtcagtttgcatcatctctgttatgttttaaaattgtacatctttttaacaaccttatcttgttttaaatgtaatatatattcatttatttttggctaattatattaacttacttgaatgcagataaatcattagtcttgaaagcttgatgctagaaaataagtaagaaacaaaatatgataattgactttactatccataaaggacagtttttttctagatagacttacagtaggcagtatttcttctatgagagaaacatgatattgataagcttttattttagggtttgatatacaataaattttaattaagatctttcaggtatgctaattttctgggttatctgcgagcttggtgtacctttgaaatataaatctttataaagatatcagaatgaaactgtgttcataatattctaatagaagtcagaagctataatacttatactgaactttcatgatatatctatatatttcatagaataacttacatttttaaaatctgtggctgttaaagttggaagctctctgttaacatttaatgatcttgtcggggaatatgattgacacaattaagttgtcttgcattttagttacataattgatatgggatgtgagtaagatcctaattcagaacatatgatactcttgttccattcctttcgagaatgaaattaaagcgacttataaataaatctggttttcattaaaatatggaaaaaaacatctgcatgccaaagcatttgcaatacagctaaggatttatactctatatttcatacttggaacatttttatcatacaggattaaatccacagatcaaacaagttctctaggaagtataaaggtttttactctaattcttttggcttaaagagaatgtatatttagatcacagtaggaaaacaggagttctgttagatcgttctttattccccccttaggaaaaaattaaagttagtacattcttctgaaatgcttatttacaaaataaatgtatttaatatgtactttttgagatttctttttactagtttgtttttctcaggcagcagttttattttgtaagtttaataatttctgttctttagaaaatatccattgagaaacacaattcatttgtctgtgacacacatgtgaaatctaaactaattttactgtgctttactgtgttgcctttattgttaatgaatggtaaagaaaagcactgtatttaaaattggctttattaagatgaattattaaggataagaaatgattaacgataaccagtagccaagacaaggatagagaaattacattttacagtataattatttttatattaagaatttaaagttcaatcctatgaaaaggagaatgcaaagcatgatcttgaaataaatgaggtagtatctgaaagtatttccattgctactgtcaccttccttttgctgattttacagacatataaaatgaagttgttgagccagatgatctctaaggtctcttccagctctaacattccataactgtgattctgagttactgctgggaggaggtaaagttatcttcagtcccacagttcagtgctttggtcagttatatgacttttatggacataaatgaattgtgatctgaaatagtataaagtaactggtgtacagaatttcaaaaagtgttcctttattcctgtgcaagagaaaagagtcctggtcctggggattaaatgctcccttttgtacaactttagcttcgtgacatttttttttcttttaaagagtgaaattggcttataataattttttgttttattttattacggtaagaacacttgacatgaaatctgcactctcaacagattttcaagtgtataatgcggtattgttatctacgagagacagcaaaactaacagatggaatctcctttggtactcctttgggcatttttcctcctggcactgcaactgtctgggtctaacattgggtcccagaaggaaacacatttcagacatagagccctgggccttttgccagcttcagaaatttggttgccaggtgttcctcaatgaaagatcttttgaagtttctgttttgattcttactcaagagtgactagaagataaacacgttgagtatcatttttgtattattgatatgtgtactcttttagtacttcctgcataccaggaattgaggggcatgtgcaaatggagagagcaaagcttcaggtccactaaagctgtaaatacttatgcataggttatagtttctggcatatgtatttcctaatgatacaaattagggtggagaagggaaaagtgtcatcatggtgctgtttctgcagctgctccttctcttgttctgttaaagaggaagttgtcagcacccaacagtaacaattaagttcatgttagaagccactggttgaaatccatgtagaagacctttgcctaatttaacatggcagtgggagactggtatctggcagagaatgaaagaggatgcgttattgcaaagtgggaattttgagattatctaccaaacaatttgaaaaagtccctattggtctttgatgccccaagctcccatttttgcataagttttactttgttactattgtgcgtgtgtatgtatgtgtatacacttaagtgtaaatatctgacagctacgataaagaaaattgagaaaaaaaagcaaagaaaaatcatgcataacatctctaacctagtcactgtccttttaattcttttgaatttttcgcaaaagctttcaaaactatagttaataattatatttatatcatcatcattttccattttattcattgtgttttttcttaaagccacgtaacattccattgagtatgctgttctaaatattttcaaatgttgggtatatagagttttcctccagcttctcaatattataataatatattcaacagcttcacatacatagaattttctctattttattttcttagattgccactacatttttattgctcttgctacatataatcattgtttttccaagagatagtactaattggcacgatcactagcaatgtatgaagtccagttgtgccacatccttgaatatttttgtttactaattttgctagattaattgaaacagtctcattatttctttaattagcaccagtgattggattttcttcatgtgtatttactagttgtatttctttcatgaattgtttctcctttgcatacaaatctattgaggtcttgggaattaactttaacttttaaaaatgtctacatatgtatctcacatattgctcatattgctatcacataaaaatatctactttttggtattttaagtatatccttctggctttatatgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattcagtatattgttatttcaaaattatcatggtcttggaggtttgttttcaatttttattattttaaatgttttcagtaaacatctttttataaaagtctttgttcttcaggaacagaaaaccaaacaccgcatgttctcactcgtaagtgagagttgagcaatgagagcacatgaacacagggaggggaacatcacagactggggcctgttggtgggtgggggcaaggggagggggagcattaggacaaatacctaatgcatgcagggcttaaaacctagatgacgggttgataggtgcagcataccaccatggcacatgtatacctacgtaacaagcctgcacattctgcacatgttctacggaacttaaataaaataaaaatttacaaaaagtgtatgttcttattatttttaatagtcttttataagtgttttcaagtatataattatttgaaaattctttatatctattgccaaattgctttccagaaaggtaatttatataatttgcattttcaccagctttttacacacctcatcactcctcactaatgttgactattatcttatttttaaatatttattaattcagtagttggaaatggcatctctttgtttttattcatttctaaatgtcaattcattaataagaaaaataggatcccacaagaacattttaatgaaaggaagtaggcttttcctaatagctggttgtaatggttataactctgtgtgtgtgtgtgtgtgtgtgtgtgtgtgtgtgtgtgtgtgtgtgtcagaacaaacactggagtcccatgcctaaagtagaactttttttataatagatattggtatcttgatggacaaacactactaataatcatatgtgttggcattgtgttccctcttgcacttcttcccaaaataggtaagtctttatagagcacattatttgtttagaaaaaggaaagaagggagggagggaaagagagacaaatattaaggggctttaaaatttcacagtaccacatttttggcagaaggatggtggttgtgtataattttaaacttggccttattttaggttgttcagccttcagccctgcctagttaacctattacttggtttgcagtagtattttgtctgccccactaaaataaaatctttacagcggaacattaaagagcagcctttccttacagtgtaccattagtggtaagccagttccaattctgctgtacagagctacataaatgatctgtgacagatagttggaatgttgttattctgagccctaagccccagataccaaccactataatagaaaacatgcctaagatgtatagctttagttgtacgttaaaatcgctttccttataaattgctttttattttactgttattttacaggctttcttggctacacaagtagtttatcatttttctttatgatgttctttgctcttgtggtaagtttaaaatataatacattgcttatctcctcactaaaattggactcattgtgttagtcttttttacttttaactgttttgtgttgggaagggtatctcattttatttcactgtgttattaaaagcacttttgttccattaaattatttccttcattgtatctattttgaagaggcttagctagaacagcatttcaaattcagcatttcttgtggttaactagagaggagagcgtgccaattctgttaaaatcctagatggagtgtaattctttgtgtaggtgtgtaaatttattcctgtaccatactgtatgaagaatcagtctggttctaatctgtaaaatctgtttgagactagtcatcttaattttgaaactttattccattaataaaaaaacagagcttctggtactacattgaggagatctagtaagaactgggttgactgaattctattttgtctggtttattcagcatagataaattctcataaaaacactactacaaatatttttcttcacatgtgggatatattccttattttttaattagctcatttttattatataaaaatatcagatggtaaatttaacttattttgatattataaaataatataaagataagaatttaaatttatttccttctaattcttctaaaacatcttaacattctaaagatagtacctttgtgtgaaattttttaagtcttttttctttgtatagcagtttattccataatcagtatctaaatgtcaaaccttaagtagaaataaacatttttaactttccaagaatatacatgtccaaatgagcttttcataagcttggttcaactctttcttgtttttgaaaatgcatgaaagaaacagccatatgtaagagcagaacagcacatcagtagttaagccatattaaagatccagatttcaaagctgtcaaaacaacctagggtgcatttaacttaggctaagctatcttctgagacacagggataaaataactttaaattatttaaacaaagtggaagtgactctgattttagtatatataagcatttattctctattgaatgctcttaaaactaaaaacatttaacagtgtttacatttaatcatttgttgaatttaacaacattaaaatcattcctcttcttctctccccagttgtctgacttatatcttacagataagtgaattgaacatacactttgtaggctccatattgaaaaagaaaaaaactaaatatttccatcatcatttgattgttgagaagtgtggttagaagtggcctacatatgcaaatgaatgtatggatattaaagagaatcagtatagataacatattgaatttttctctcacagataattggcaatgcaatcattgcatagataggagtaatttagttttcatagccaatagcttaaagcaggttaaatgtattgatatgatatgtctactgtagttttgtttctgtcatgacagatactctttaattcaatgcagatttctaatgtagcagccatatggaaataatacccatattctacatttattgtaatgccttataaaccatctgctcagatttttacctgtgagcacagtttaatctacagtggggcaatgaagaatactctgtatgcttttttaaatactctttttaattggcatgtttattttattatttatttatttatttattttgagacagagttttgctctgtcacccagggtggagtgcagtggcacgatctcagttcactgtgacttacatctcctgggttcaagcaattctcctgactcagcctcccaagtagctgggatttcaggtgcatgctaattttttttttttttttttgtatttttagtagagatggtgtttcaccatgttagccaggcaagtcttgaactcctgacctcaagtgatccacccacctcggcctcccaaagtgctgggattacaggcgtgagccaccgtgcccagccaccatatttattttagattctctgaatgttatcttttaaaatacatagtggttaggaaaaggaaacgtatatatattaacccagaattttggaaggataccagtttttcatttattattcttgtcaatatgtgtttgtaaatatgtatagcatttatatcatattttttaaaaatcagttcaggaactattattttcttatattctttgaataatataaactaaaacctatattttatctgttctcccagatctgtattttcattaaaaaaatttaacctaaatttttgccccctctaaaatattttgcaattttaaaaataaattatatctgtctcagaatgataccatcaagatggatttacctttttttggtaaatttactttttttttggtgtattttagagcacaagcggattaccattcgttctaaaagttctatcttaagtacagattagtattctaagcaacgttttaatacgtcggtaatccagttagacaacttttttttttaagagacagaatctcactctctccagtcacccagactggagtgcagtggcatgatcatagctcactgcagactcaaactgccgggcttaggtgattcttctgcctcagcttcctgaatcactagaactacagctgcataccaccacgcctggataatttttttttttttttttttgagatggagtctcactctgtcacccaggctggagtgcagtggcgccatctcggctcactgcaagctccgcctcccaggttcacagcattctcttgcctcagcctcacgagtagctggaaccataggcacccgccaccacgcctggctaattttttgtatttttagtagagacagggtttgaccgtgttagccaggatggtctcgatctccagacctcatgatccgcccgcctgggcctcccaaagtgctgggattacaggtgtgagccaccgcgcctggccagataaatttttttttaaatgttggtagagacagagtcccattatgttgcccaggctagccttgaactcctatgttcaagtgatcctcccaccttggcctcccaaagtgctgagattataggcgtgagccactgcactggcctgaaatagagaattatttaaatggtttttagtcagaagctttgcttctactgaacactatgttaggcattttaggatgtggaaatttaacctggacactagtcttaaggatctgtcaatctagtaggggagataaatttcttttcaaacatggagaacagtgtgtgcaatatataaataagtattgatatatttgcttcagaataagagtctcaagagttgagaggagagaaggctcactgagagctagagtaaagaaggattttagaggaaatacaacttgagttgagccacaaaagaagcaaagggcttagagcagagagaaggaagggaggccttttgtgcaagtgaacaaatatttttaatacttagtctcctttttccctttgtcattccaaccccaagacttaccttcttaccaacctaagcaaggacttcctgttaatctttcctctctgttgttgggtctcgtttcactcccgttctgtacttctgctttgtgggacatcatctctatccaccccataccaccatacaggcttggagttgggatggatctttgcagagaaattagctgtagtaactgaactgtctattaatataaaatcaggctacttcttatttttttcaaattaataaaaattaatgataatattgcactttggagcattgctttgaaatattttgatttgaaagcttaagaaataacaactgataaatgaggcagctcacatacagagtttatctaggtacctggtgcacagcaagtcctcagtaaatgattttttctgccaacactaccactgttagttaggggaaaatataagaaactgaatttgggcctgtgcagtggctcacgcctgtaatcccacactttgggagcctgggacaggcggattacttgagcctaggagtttgagaccagcctgggcaacatggcaaaatctattctctacaaaaaacacaaaaattagctgggtgtgatggccacacacctgtagtcccaggcactcgggaggctgaggtggaaggatggtttgagcctgggaggtggaggttgcagtgagctgagattgtgttactgcactccaggctgggtgacagagtgagaccctgtcttaaaaaaaacaagaaaagaaactgaatttggagcagtttcaccctcacctcatcctcatcgtttttttttgttgttgttgtttttctttgaaaacctataaagataatgatggtgagattattgcttttgattttgttatttccttttggtaagttgaccgtttcattttatgtcatattgaaaacttacctagaaatgtcaaagcagcttgtctagtttatccttctacagtaatttttttcttggtgaggtttttaattaagagtgattctttagttcactcattaacttaatcctaaaagtatatgttttccttatatttgttttatcactgtgtaaaattttgattaaattagtcaaaatccaaaactaggtaaataccaagtaggaatagaaattgtgtttacatattggtctcctacaaagaacaaatacttcctttattctttcttgtccttttgtgcactgggattcaccctggagcaaacatttacagagtaattatgtgccctgaaacaacagcaacaatggtaatattgacagagccacagctataggtctgataacaggatggccacaattaagagtaaaaacatgaaacattttcattgattaattctgggaaacagcatccctctggatttcttttaatgttttttttgtttgtttgtttgtttttaccagctggagttccctagctatatgctcctattccagccagctttctccacattaaccaaaaataattcagatctgtaaaagtaaggaggggcagcacttaatgtgtacatcagaaatccctgagctccttctgagtataaagtctgtacttatttcttcctgtggcctttccataaactgctgttaaatgtttctctattcactaatacctactctacaaataaccatattcctgtgtgacagtcactgaaaacatcatgttcctgttttgagttgcacttaaaaaaaaatgccttgatgctgttggaattttgaaagttgacacaggagtacccttagtctttaatgggggagatctctacttaacaccctgcagtctccaaccgcctccctaccacaggtgaccatgttaaatgttgaccccattctaaccgggaaaagtcacagaagcagagactcttctattagcatcttatttaattgaaatgatactgacctatttcaattcagtttcttattaattttataagaaatgatctgagtgctgattctgtttacttttttaggtaataattaaaaaatggtccatcccttgtcctctgacattaaattatgtagagaaaggtttccaggtaatagcttatattttcttttcagtttcttcctttttattttaactaaaaagaaaagaaagactaatgattcttttctgattgatgaaaaagtaatggctatattgcattttagaactttgttttgaaatactttcatttgaaagcctagtaataataaattcatcatttttattgatatattctgaaatttaatggctgttggtttctctttttcccctcaatgctcttaaacagatttcaaatgttacagatgattgtaagccaaagctctttcatttctccaaagaggtgtgtaagttattaacagatacttttagttgatttttcacatttcaagttttaagaggtttgtgtaacagggtctcttaggtctttgtacctgtgactaattaattttcatgaaagtgctaagtataggattgcctaccagaagactactattatttaacacagggtggcctattatgaaacagccacctttttttttttttttttttttttcctggtatgcctttgaatggagcctgttttaaatgggcctctgcctgaaagaacagatttaccgaatgtctggtctggccaataaggtcctctgtgtataccaacttcctgttgccctctgcacttgtaaagctaaatagccaattatatcaaaaactcttcccctgtgagtagaaccttggtctgtagctaaacagcctcatcattggactagggattgagcactgccaatatatcttctggccgacattccaaagttgaaattcatgatgccaggagtagagactaggagaccaagtccctttgccttccctaaaagccataggatactggaaatgcctgtaagagcccctgagcatcagcagaggagacaagaactgtgacatggatggtctctgctttaccactctagaagagctcaaagtcttccctgttgctgcaggcttatttgtctatactttctgactctgctgaaatgctattttgtatagttcccagatgctagaatcccccctgctcatgtaaaactctattagtgtagaatgttagcttggttactccaccatgcagaattttcctttttatctctagtttttaaatgagaaatatctctctggtcccaaaagggagattaccacatcttttacatggtaaagacctccaggtgccgtaaagatctaggtaggataattgacaagccaggaaactgagcaatatatgaaatggagaatttgtgaattaaactctcattttcctagtccagcctcaggaaacactacagcttcctctctcctaacccccttcagatattttaagactctaggcattatgtcccaagataggtcttcatttctggaatttcttttgtttaagagcctgaagttagttaagtggaaatttttttagagcagaaaggagaaaatagatcaccatcgtctatttggtaaagatggtattttcacttaaatggtaactttttttgctttactctgactcttaagtattctaataataaaaacaaaacaaaaccttatatttgtatattacattggatctcttaagagtttgtaggtctagaataaatgatattcattcccattgaaagagatcctaatcaaagatgctggcaatattaaaatgtgattaatattttcagtattcccttggattgagttcatgaaagcaggttcaagagcattaactattagtgctgcttagagtaataagatacatttaaattgtgcgtacatttagaagacagagaattaaaaaagagcatttctaaaatgttatttttatctcatttaaatattatttatcttatgtaatttttaaaatcttatccagataatgtagaagtagtgattgtagtaaaagcagcatggtatgggcagccaaataaaaaatattctggctagtacaggcaagcccactatcaaataaaatatttgctggatcacaagtgtttttctcttttaaaaaattcttattttataaagagaagactcattaaagatgaaataaatgtaatcaaattgattttttaaagaactgagtttgttgtcaaatgaaataatggtttcagtagagtggcatttaataattttgtctctttaaaatttttttcagagtgcttatgccttaccaaccatggctttttcatttctctgccatacctcaatattgcccatatactgtgaacttcaaaggtactgtagaatcctggaatattttaaatatattgtgtatctttttacctctaaggctttcggattgaatgacatcctcttttattaatcctttcctctcatcagtggatcctaagtgttagtttaaaacaaaacaaacaagagttagttctgtccaagttaagaatgtttcctagaagtgtaatctttgaggctggcctgtaatcccagcactttgggaggccgaggcaggcgggtcacctgaggtcaggagttcaagaccagcctggccaacatggtgaaaccccgtctctactaaaaatacaaaaaaaatagccggacgtggtggcgggcacctgtaatcccagctacttgtgaggctgaggcaggagaatcgcttgaacccaggaggtggaggttacagtgagccgagatcacactactgtattccagcctgggcgacagagcaagactctgtctcaaaaaaaaaaaaaggaagaagtgtaatctttgtgtactaatttcgaatgaggacttctagtgtatagttattgatggagttgttcttgaatgaggaattctctcgaccagcttaggacatacttgtttctttacatataattcagatcacttattctacctttgtcatttttgtcttttagtccttcaaagaaaagaatgcagaatgttaccaatacagcaattgctttaagttttctcatttattttatatctgcactctttgggtacctcactttttatggtaagtacattttaaaattatagatgacaaaataatagttacatagatggcctcacgccaatctatagactttacctatgccttttattactaagttaatttgctcagatcaccaaattacaatgcagtactgtggtggctcttgaggcctaaacaattggattatctttcttttagaaaggtagttcaggtttaagattaatgacttcttatgaaaattttcttaaacacttaagtaaaacttcaggcttagggacatgattctttctataagaaaaaatgtgcaattttaatgattctgtttttcttaaattttgaattcaatatattagtctaattcagaagtgtgggggttgggtgagtcagtcatcttaattgcaaaagaacaagttgagaaaggaaagggttttacacagaactatatctgtatacttagatgtcagacatctctgccttcagatctaattatcacaggattcagcagatgtgcattctatgatgcaccatgaccttcctccttaattatttttacaggttcttttaaatttatgcaacaaaaataaaattgtgttttatttcttttgcaaaaactgtctgctttgtatgttgactttttttcctcttctgataagaacctcaagaaaaagtaaagttctgtgtacaccatcaggaaaagcattatttccaatgtgagcatggtgccctgctagagacgctacaaagaaagttaaaacagattgtcaagcttttctgatcatcattaataaaacaaaattacttaaatatataaactttatttttggatgttgggtttgttagtttttatacagacttgaactcaataagacttttctgtgtcaataagatactgtaacagggtctcttgggatccaaaaatattttgtatagtggaatagctatatatttcttttattaaaattgctacctggcacaaacactattatatttagggatcttcagcaataagaaaaagtccaaaaaaactgacctccttcttctccctatggataaatagaactatctggaagaaacctcagatggcttgccaatatccaggctggctgagaaattgttagatgaatcaccattaggtgcttagaaactgtattaaattgtagctgtattagattgaaagggatgtggaggaaggatggaagctaatacatttattgagctaacatttaagacagtgtcaggtattttatatatactccctaacttaatccttataacaattctgcaagctcagtgtaggttcatttaggttgagtaattagaccagatacttgaagccagttaatagtggaattgggatttgaatctagttttgtctctctccaaagccaatgcctttattactgtgttgtctactcagaaattgtgctatagaagccagatttcctttattccaagtttttgttaaggtgatcttttagaaaaatatgactcacttaagctctaggcatctatctatgtatgtatctatgtataatctatctatctaacattgctgcttgaacacaaaggctaaaggttttcatcatgtagatggcatgtttcctagacagggatttgtctaatatcaagtaaaaccattatgttgtctctgatttaatctcttctccactaatgcaaattcttcagagtatgcaaattttatataatagagaaatacacatctaagaaaatcacatggtaggtaggtatatgattgattaataggtaggtgggtaggcagatagatgggtggatgaatagatgatagattagatagatagatagatagatacatacatacatacatacatacatacatacatacatacatacatacatacataaatagaataaatgatacaaaagtagtaagttcttctccaaagacagaagaggcagatattgatttgctcttggattgtgaatcataaccaagaaaaacctttgatcatatctttctaccaggataacaggagctttgtgtcataggaagaaattgctggttgaacctgagatcttataagggctagcctcaacttaaggcttccaattcattttacagatgaacaactaaagcccagagaggtgaagtgacctgtcacagaattaaaggcaggtttcctgaatactaatccagtgttatttctgctactttgtgataatctttgtaaacttaataccctgtttgacaatgtgtattaaacaggacagcctcctgacttcaatggcatatataacttgcagagatcaccattaggccctttctgagatttgtagagatttgtctgaatccagggaagcatgcaccactctatccctcacatatgttatggctcagttaagaacacagagtgactggctcagaagaagtgttttcatcctgggaaagtagaaagtggacatgtgacatctattttgaatttgtaataaatctagttcttcaagattcaggagctgctttggatccttttatccagagctcctaaagtttaatttctaaatttgtcagattaaagggacttataggtatgtacctagattaatgatacttgctctgattacagctgtgaaaggaagagaaaagggttcctctggtgagccaggccagtgcccaaatgttgcataataaccaggccatttaaaaagtctatgaggttgttaagcaagaagtgttaatagctcattttatgattcagaaaatggaaataaaatagtttgccatatttctccaaagactcacaagtatctcacagatttggaaatagaatccagatttcctggctcttcttagtctcctacttagtccaaatcccacattgtgtaaagtatgtttttgatactttggacaattcatttctctcctgtttccattatcactagtctagttcagattctctttacctctcagtgattgtaacagtagctgttatgcctgtttggggtctctttttcttccaatccgtactcctgctttagttcagatcataatacactgttctttgtaagtcattattgcatttctgtggcctaccaggttgaggccacatctcatgcagaactgtattactaggtctgaaatgcatttccagccctatcacccacacactgtttcatccactgtagtacttactagaccacttattttctcagatgcacattccctttgctttgtttgtgctgctccttgcttctagagaatctcttcccccacatctttgaacatcagcacacattcattgactcatgtaatgttctcagtaaccctatagtttagtatatggccatccccattttaaagatgtaggaactgagagactcagtgtaagttgctagttactggtggggtttgaacatgttctatgtcatcacagtttagaatctccatagctcttgtttagaactctctggccacttacatgtgtatatcacactttctatcatagctatgtgtattcatctcatctcttcttaaagttccctgagaacagaggtatgtttccttttgtttttggtttccctcaaagtatcctttctgaaacactctcaaattaaaaggcaccattctattttaagtacaaactgatattttcccacaaaacactgatatccagtgtttctgagcaccctcagtcttctttccccttgtctgggttgaggttagggagacattgtgagaatgcaagaacactggagcaaagcttggtcggcatgtataaatcctattgctgaccaccacacactggcctactaagtaagacatttccctaacacttctctttttttcataaaacatgaatccacagatgaaacgtaacatgcaccaagctctgagattctagaaaacgttgtggtattgaggaaaagatgctgtctctagcaccaaaaagaagtaggtgtatggcactgcccctttgtgttatgtgatcttaggcaaatcatttaacacttttggacctacctgcgtattaatattgttatcatggggactaaattcaacaacacgtgtgaaagcactttataaacaaacagcacaaatgttcaaacccttagattatggaaaagttccaaagagataatttagtatacatattcattgtcataatttgagaggttctgcttattctggtttttattaaaggaaaaagggtgttaggtttcaagaagatatttaattaatgtctctgtgtttcataggctaggggaaaggccaggatttggtaatgggaatctaaaatctgttatcatccattagtgcaaaggaaaacaattttgttactattgataccttagtactttataatgtgatccttattattttatttacagacaaagtggagtcagaattactaaaaggttatagtaaatacttatcacatgatgttgttgtcatgactgtgaagttatgcatactatttgctgtgcttttgacagtccctctaatccacttccctgtaagtactcttaaagggttttgttgcctagtatagacgcttcctaatagggaaacactaattctttgcagaatagaatgtttgaatcacatctagtcttgtatatcttattcacttgtcaagtaattgatcaaagacttcatacttgcatatggccccgtaaaagcataaaaataacagtgagccactaagctaatttgtgctttttgagatttagtttagatttacgttctcccacagcattgtttccaatttagaaactatagttcttctaaagttttgggtttttcccccctttaattctgtattctgttttcaaaaaaatgtgcatgaagaggaaaaagtcaagtcaggaaaaataagctccttctgggtttattgtaaatttattttcacataagcattctagttcaatcttggtgaaaatattttatttgctctagaattgtaatttaaggggcaaaacagattttcattgcatctggttgctatacttgagaatcttaagaatttctgagaaaaagggaacaaaggctttgggtataaatgcatctgcatggatgtcttgaatctctaatgctgagttttgtaagagctggggcttcaagcctcctccctgtgtgggctgcagtgccaagattacagcagggactggataaattttttggcatgtgaccgcctgctgtgctcttagcaatgggaagtgtagtgaactattttttcatatttacaggctgtgaaacatataaaataaaatagtaagtggtatttctttcccatggcatgatttctttttctattataaattgtctgtttttttaatctgttgcatttaatgaaaatcattctttgagacttttttcatatttttattgttggtaattttaaaaattatgcaacctaaaaaaattgcatgtgaaaactttttctagcattaaagctaagtatttttatgaagcttacacagaaagggttagtatataaacagtttatgtgtataaatactttataataatagtttatgctgtatttttgaaatctaaatgatgtaggaggcaaaaatatcatggttgttgtatatgtttctctcagcaaatatctggactttgacatttcctcttcgctatatgtttatttttctgtaatacaggccagaaaagctgtaacaatgatgtttttctccaattttccattctcatggattcgccattttttgatcactctagcactcaatattatcatcgttttacttgcaatatatgttcctgacattagaaatgtatttggtgtagttggtaagttttctgtttcaaaaagttcacataataaaattgataaaattgctacccagcctcacatctgaatccagcaatatcctctcttttttttccctccactttaaaggtgccagtacatcaacatgtttgatttttatattcccaggactattttatcttaaacttagcagagaggattttctgtcatggaaaaagcttggggtaggttgtttttgtttctttctttcaagacttctattttaagaaatagtttgtcagtttatattattttacctgcatcaagaaagtcaatatattttaaaatatagaatacattattgcagagagtagagatttaacaaataatccaattgtatttttttatcttttttcttttatctttcttatcttttatcttttttcttatttccacaggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaatatattgggttgatcttttgttttttaaattaatatttttatggtagttttatgtttgcagaaatactgaacagaaagtacagagttcacatataccgttttaccccaacatacagtttcccctattattaactcttgcgttcatgtggtacatttgttacatttgatgagccaatattaactattattattaactaaagttcatagtttaccttaggtttcattcttggcagccactagcaaccactgatttttttttaacttttattttaggttcaagggtacatgtgaaagcttgttacataggtaaactcgtgtcacgggaatttgttatacagattatttcatctcccaggtattaaacccagtactcattagttacgttttctgctcctctccctcctcccaccctctacccaccagccccagttgtttttttctttgtgttcataagttcttactatttagctctcacgtagaaatgaagacatgcaatatatggttttcttttcctgtgtgtgtttgctaaggataaaagcctccacctccatccatgttcctgcaaaagacatgatcttattttttatggctgcatagtattccatgatatatatataccatattttctttatccagtctgtcattgatgggtatatagggtgattccatgtcttggctatagtgaatagtgctacagtgaacagtgctacagtgaacatttacgtgcatgtgtctttatggtggaataatttatgttccttggggtatatattcagtaatgggattgctgggatgaatggtagttttgcttttagctctttgaggaatcaccatagtgcttccacgattgttgaactaatttacactcccaccaaaagtgtataaatgttcccttttgtccacaacctcaccagtatgttattttttgactttttattaatagccattctgactgatgggagatgataatctccttgtggttttgatttgcatttctctaatgatcagtgctactgagctttcttatgtgcttgttggcagcatgtatgtatgtcttcttttgagaagtgtctgttcatgtcctttgcccactttttaatggggtggtttttctcttgtaaatttgttcaagttcctcatagatgccggatattagacctttgttggatgtatagtttgcacatattttctcctgttctgtaggctgtttggttttttttgctgtgcagaagctcttaagtttaattagatctcatttgtcagttaatttttgcttttgttgcaattgcttggtgcctttgtcatgaaatctttgcccattcctatgtctgggatggtattgcctaggttgtcttccagggtttttaaagttttgggttttacatttaagtctttaatccatcttgagttgatttttatatatggtataaggaaagggtacagcttcaatcttctgcatatggctagccagtcattccagcatcatttattgaatagtgagtcttttccccattgcttgtttctttcagctttgttgaagatcagatggtcataggtgtgtggccttatttctgggttctctatactgttccattggtctatgtgcctgtttttataccactgtcatgcagttttagttcctgtagtcctgtagtatagtttgaagtgggttcatgtgatgcctccagctttgttctttttgcttaggattgccctggctattcaggcccttttttggttccatatgaattttaaaatagttttatctagttctgtgaagaatgtcattggtagttttataggaatagcattgaatctgtaaattgctttagccaatatggccattttaatgataacgattcttcctatccatgagcatggaatgttttttcatttgtttgtgtcttctctgatttatttaagcagtgttttataattctcattgtagaaatctttcacctccctggttagctgtattcctaggtattttattctttttgtggcaattgtgaatgggattgtctgatttggctctcagtttggttattggtggtgtataggaatgctagtaatttttgtacattgattttatatcctgaaactttgctgaagttatcagctcaaggagcttttgggtggagaccattctagatatagaatcatgtcatctgcaaacagagatagtttgacttcctctcttcctatttggatgtcctttctttctttctcttgcctgactgctctggctaggatttccaatactatgttgaataggagtggtgagagagggtatcctcgtcttaacgccagttttcaagggaaatgcttccaggttttatctattcagtataatgttggccatgagtttgtcatggatgcctcttattattttgaggtatgttcctacaatacctagtttgttgagagtttttaacatgaagcagtgttgaattttttttttttttaagtctttttctttttttttttctttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtatctgttcatgtccttcgcccactttttgatggggttgtttgtttttttcttgtaaatttgtttgagttcattgtagattctggatattagccctttgtcagatgagtaggttgcaaaaattttctcccattttataggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccaagagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggaggttttgggctgagacgatggggttttctagataaacaatcatgtcgtctgcaaacagggacaatttgacttcctcttttcctaattgaataccctttatttccttctcctgcctgactgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattctgaaatacgtcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtaggattcagctgtgaatccatctggtcctggactctttttggttggtaaactattgattattgccacaatttcagagcttgttattggtctattcagagattcaacttcttcctggtttagtcttgggagagtgtatgtgtcgaggaatgtatccatttcttctagattttctagtttatttgcgtagaggtgtttgtagtattctctcatggtagtttgtatttctgtgggatcggtggtgatatcccctttatcattttttattgtgtctatttgattcttctctctttttttctttattagtcttgctagcggtctatcaattttgttgatactttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcgtttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgttgggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgacctgcttcggctcgcgcacggtgcgcgcacacactggcctgcgcccactgtctggcactccctagtgagaagaacccggtacctcagatggaaatgcagaaatcacccgtcttctgcgtcgctcacgctgggagctgtagaccggagctgttcctattcggccatcttggctcctcccccaagtgttgaattttatcagaagccttttctgcacctattgagatgatcatgtggtttttgtctttagttctgtttatgtgatgaatcacatttattgatttgcatatgttgaaccaaccttgcatcccgtataagtgtacttgatcatggtggattaacttttaatgtgttgctggattcagtttgcaagtattttgttgaggatttttgcatcaatgttcatcaaagatattgacctgaagttttctttttttattgtgtctctgtcatgttttagtatcaaggtgatgctggcctcatagaatgagttaagaggagtccctcctcctcaatttttttggagtagtttctgtaggaatagtacctgctcgtctttgtacatttccactgatcattttactgtctccatagttttgtcttttccaaaatgtcatatagttgcaatcctatagtatgtagccttttcagactgccttatttcgtttagaaatatgcaattaagtttcttctatgtctttttgtggcttaatagctcctttctttgtagcactgaatagtattccattgtatggatgtaccacagtttgtttatccattcacctgttgaaagatctcttggttgcttccaagtctttgcaattacaaataaagctgctctaagcattcgtgtgcaggtttttttgttttgttttgttttgttttgttttgagacagagtcttactctgtcacctaggctggagtgcaatggtgtgatctcggctcactgtagcctccatctcccaggttctagcaattctcatgcctcagcctccccagtagctgggattacaggcacccaccactacgcctggctaattttttctatttttagtagagatggggttttaccatgttggccaggctggtcttgtactcctgacctcaggtgatccatccgcctcgacctcccaaagtgctgggcatgagccacgatgcccagcccctgtgtaggtttttatgtagacataatttgcagcttatttgagtaaataccatggagcacagttcctacactgtatggtaagaatgtatttagttttatgagaaattgccaaactaccttccaaaatggctgtaacattttatattccagagagcagtaaattagagtttctgttgtcttacatcctcaccagcatttggtggtgtcagtgttttagattttcaccattctaattggcatgtagtggtatctcgttgttttagtttgcagttccctaatatgatattgagcatcttttcatatgcatatttgccatctgtttattttctttggtaaagtatctgtttagctcaactctcttttgccttttttttttttaaatactgggtcttgctatgttgccccgactggatttaaattcctgggctcaagtgatcccagtgcctcagcatactgagtagctgggactgcaggcacataccaccatttgttaattgttttctcattgttgacttttaagcattctttttagattttatatttctggggttttgttttgtttttttgagacagagtctcacttccgtcacccaggctggagtgcagtggtataatctcggctcactgcaacctctacctcctgggttcaagcaattctagtgcctcagcctcctgcatagctggaattacaggcgcacgccaccacacccagctaatttttgtatttttagtagatagggtttcgccatgttggccaggctggtcgcaaactcctgacctcaagtgatctgcccgcctcagcctcccaaagtgctgagattacaggcatgagctaccatgcccagccaatttctgttctttatatgtgttttgcaaagatttttttttccccattttgtggcttgctgttttattctcttaacagtgtctttcaaagagcagaagtgtttaaatgttcttaaatatattgggtcaatcttttgtttgtttgttttaagaaatcagtgtattaaatttatatacaaaattgattcttagctatgttttaattttgttagcatcagtcactaataacaaaactgagattgttctacttggtagaatttagagggattttgccctccctctaaatcctatctaaaaacttttataactttcctcttctgttcattatgagatagacctgtgatgactgcctgtgtacttcaaagtcctttctctgagttttcttagttggtcactaaaacaggcaacattctacttggcagagacaaaatgttgatcatttctataatattttgtttggaggttataaatcattgcagcttctcattgacatggcttatttcaggttaggaaccagaacctagggctctcctcccatgaaattctactaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaactgagcttctcttttgagaagatcaagatatttagcaactggagaacagtgtagtgtaatggtaaaagaccaagctcttgggttagaaagacttggattcaagtctcagtgtaaggcacactacgtaacctctataagcctccatgttcacatctgtaaaatggagttaatgcctattatacagggtcatattgatagaattaaatgctctgtataaattaggtgcagaccaaaacagactcttttgatagattaaatgtttatcccctttgtccattcccttatctggaccaatgaaatgagtttgctttccactaaggacatggaaacataccttgaatttcttcatcttgcatgagaattattttcagaatctttctctagccttcactcacaggggaactggccccaggtgcacgttttgagtgctttcccacagtttacctcagctgtactctcctactaataatgccttcctgaaactaggcacttagaatggtcccaggccacagccagacatggcctcccatgtggcttcaggtcagccagagccagtcaatccgatatcctactactcgtaccctcttcttctgtttatgacattatggatccaaatacagataggtgtgcagctacttaaataagtctaactccagtaataccaaaataaccctaaatctgcaacagatgcaaggatgccccctgggggcaattgttaagtgtgatgacagctgggcatcaattaatacatttgtcacctgctcatgagataggatcatgggaggtttggcaaagggacagtctgttgaacactgcacaaaacttagtagcaagaaaaattatttgtgcaggtattcatttttattttactttaatgttctgccttatctagttgcctgttttgagtcacaactttctctgtgcatttagatgaggttaataagatggctggtgagagcagtgcccccttcagccaagattaccaaaaaaaaccttgttcaaatgcccctcagaatttttcctgggaaatatgggccttctcattatgggcttaatgttcataatttattaggtaataactatttaaaataaaactaagtaaagcagaaaatatatacttttctaacatttggagacttgtttgctaaattaaaagacgaagtgccaagactataaattactttcgtatgttgagggtgaatgtttaaattgtacttttttatttttaacagaatgtttactcatgagcttagcatttaaatggttaaaacaaggctttgaagttaacactccattaagatgaatgggggtaattcacacctctgcttgtgctatattatttcagtctggttgcagagaaaacaagacagcagtaggttgatttactgtgtgaaggccctttaaacacccaaggtctggaaatctttggggtgtgtgtgtgtgtgtgtatgcttttccatctagaagcaggatctgaaattcaatacaatctaggtatagaatcgaggtcttgaaaatactaaagattctctgctatccagcaattccatatctggcatttgacgggtagcacgttactggatcaacccaacctctctggctttgtttgctactgtactgtagtgtttcttcctaccacagcattttttaaacttcagcttagtatactggtaaatccatcagtggaaaagcagaaacgaattatccattttccggtgaactttgtatgtgccttcagatgggttatgagctaagcattggtcttcatgtgctcctttttaaaacattttcatctttgcaaaatctcctgttctatatttacctacatataaagcatctacctttaagaactttacaattttttctcatatccctggggtagtgaagtaagcagagatcagttgaaaaagagacatttctttctcaatgtgtcctttaaaccagttctatattgtatttgaaatgtgtattccacccattggtggaagtgctacagccatttgaccctgaaatgattcattttagggcctgggaataaggttatcttaacacaaatgaaatggcaaacactgtataagatgttaatgagtttggaagatctatctttaaggtaaacagatttttctcttctctcttctctgtcctgcatgtttgcaggctcaggttactgggtaatctgtgggtagctaggtgtggagagtacttccactctggctggctgtagtgctgacactgccaatacagtatatacagagagaaaatagatgctagaaacagagggactcaaactgaattaattttaacctgtttttctttttggcatgttaacagctctctgtggctgtgttagaattagccctatgttaaacatactttacttcctgcaaatttttctgcctagattttaggtgtcataatttttgaccttagaacatttcagaatctttttattgtactgagaaatttgttttttaaaaaactcaaatacacaatttattcttctgataatcttcctgtattttttccataaggaggtaggaaaagtaggaaacaaaattttgatggaggatgaataaagatattgtggacatggtttctttattgcaatcagaatcctttctgtttgtcacccttcctaaacaatctgataaatgtgtttattatcacagtaatctgttgtcctgctttgccaagctgtcagtcaggacaagcaattataaggaacaggaagactcatcttggctgatggccaggtgggcaggtgggaataagaggtttattcacctgtggtacaaagtaaatgggtagaaaggaaaattgagttgccagggagaaaaaaaaaacacaaaaacagatggatgaaaagacattgtaatatgggatgctataaagaaaaagacttgcagagaaatgtttctcacttgtttgagtgtacagtcatcccttgggggattggttccaggatctccctcatatatcaaaatccatgcacattcaagtcctgctgcagaaccacatatacaaaatatcaaccctgtgtaaacatgcgcagattttgcatcctgaaaatactatattttttatccgtatttgattgaaaaaagtcaactgttagtgaacccgtgcagttgaaacccatgttgttcaagagtcaactgtgtatatattttatctagtgttcatcagtggacagatacacaacacaagcaaaagggctggctaattcattcagcaaattcttagcacatattatgtcctagaagttgagctagtcccaaggtcatgaaactatgtaagacatacatacatcttgcttgaaaaaagttcagatacaacttttatttttctgactgaacattttcagaccaacttgataagtgaaattgcttaaatgaaaaattatacatgtatttttaatatatacatatgtttttaaaaaaagattttggagtcaaaattacctgtgttcgaatcccagcttctgtctctttctatatctttctaattttggacaagttactattctctgaacttgctgaagactcaatatttgactgggttttctctcaaccagaggaaactctccttcaagtgagattacatatttgggaaaaactcgagtaagccgttaagcattgaatatacgtacacttttattactttactgtccctcaaatcacataacttccaaccatgttgtctcttctgccgtctctgcttcagacatttagtcagcagcctgactagaaaacggtattctagaaatatcctgaccaatgcatttattttcactactgatgtatttttccccggaaaaagtaattcttgtagtttcatagtaaatattatccacatattttgactttacatcagcatttttagcaatgacattacacttttggcttataaagtatgtggtcagaaaagctgcaggccttttttaggtaaattaccctggtttctagaaccctgtacttgtgctgttgatttacattttttaaatatgagggaatatacatgcacacacacacacatatatatatatacacatatgtataggtacacatatacatacatacatatgtatctgttatctatgtgttaaatttcatcctgttagcttcagtgcaccacttaagcagttgagatcttttttttgaatcttgattctagtgcatcagtcaccattcccgcttttgtgacattcttcatcatacttacattttttcatcccattcacagataaaaatgttaaatgagacaagactaaccagagggccctgcagcccaccgctatcagtatttctcttgagttgttattaatctatactttggatgaagttgttaatattcctgtagtgtcatctaacctgcatttcctcacttcccttggaagtgacccccaaatcagtgggtacagcctaaactcctatctgttttctgtatttctagttgcttcagaacatttctgcttgggggctccacaatcacttcaaacttaacatgtccaaatccattcctcactacagttttctcatatctgtcagcagcccctgttttcatccaacatcccaactggctttcttgcttccattcctgctacctacagtccactttcatactgcaaagtagttgtttaaaaattcaaatcagattatattgctaccctgattaatttcctccaagggctttccatctcacttagaatgaaatccatgccatggcctacaaggctcaattttgtctgtacctacttatttctctgatgtcaatgtatctttcattctccagccacactggcctttctgcccctggaacacaccaagcttgttccctcacacttactgttttccctacttagagcataattttcaaagacctttgcaagccgggcttcttatttaagcctcgggtcaactgtcaccccctcagagaggtctgccctgcctgtcttatggtcatgaccgtcttatggcccccaacacatggtagtgcttttaactttaccctgttatacaggtcactgctggaaatcttgtttatgtgttgtctgtgtccactagactgaaagtttcataagaactgggacataactgtcttatttataaccaaatcctcagagcttaggacagtgcctggtactttggagtggcttaatatttgttgaatgaatgcataaaggaatctaacagactgtgtccttctactctttacctctaatctgtcacaatgtcagttcttctttgaaatgcctcctagatttgcttttatgctgacccagcctcctgccagactcctatctaaatctcagccttcatctctttgtgcctgaagtattgcagtgattatcacttcaggctgttctttggcatcacttgggcaactttgcaaaaattaccacatgcaggttccaccccaaccagttaaatccaaatctctgagggttacgacccaggcatcgataaacttcttagagcttcccagatgactccaatgcacaactactggattgccatatctacctgctagcagatgtatgtcttccagcccattttgcctgttactgttctctggtctccttggaatcctgctttcatagtattactctcttgctcaagaacctataatggctcactactacccccattaatcccagataatggctcactgctacccccattaatcccagataatggctcgctactacccccattaatcccagattcccttgcctcatccactaagctatatttgagccctttcttacgtatgttctacaatacccttaaactgttttttctgtctagcacttgatttgccttttattaccctcttctatattgttactcctctccctactcccacttccaggtacatacccagaatgtgacttattttccacctatccaaatgcttctcattcttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatgaaatcctttgcccctttgacttctctttacttaacattatgactttttttagttgtgctaaaacaaaaaataaacaacacctaacatgaaatctgccctcttaacaaacttgtaagtgtacgatatagtgttgttaattatatgcacattgtatagtagatacctaaaactttttcatccggcatgactaaaactctgtgcctaattgaacagcaactccctatttccctgttcctgcagtccctggcaactgccattttactttttgcttctatgagtttgactgctctcgccatcttgtaccaaggaatcatgtagtattttgtccttttgtgactggcttgtttcacttagcatattgtcctcaagtattatgcatattgcagcacatggaagaattttcttcattctttaaggctgaataatattccattgtatgtgtataccacaatttctttatccatgaatctgccaatagacatttaggttgttttcacctcttggctattgtggataatgcagcaacaaacatgggagtgcaaatatctcttccaagattctgttttcaatcattttgtttaaatatccagaagtgagattgctgtatcatatggtagttctattttaaattttttgaagaatctctatactggtttccttaatggttgcactattttatgtttctatcagcagtgcacgagggttccaatttctccatatccttgccagcatttgttttttgttattttgataatgatcatcctaacaggtgtgaggcaatatctcattgtggttttgttttgcatttccctgataagtagtgatgttgagcatcttcatataatgtctggtcgtttgtatgtctttggggaaatttctttcatgtcctttgcccattttaaaatttaatttttttgttactgagttgttgtagttccttctatattttgtatattaaccccttatcagatatgcggtttgcaaatattttctctctccttaagatttttattctgttgattatttcttttgctgtgcagaatctcttctgttggatgttgtcccacttgtctatttttgatttagcattatgttttggagattattttgtatcagtatacacaaaactccctaaatattttaacagctgcatagtattctgttaatgcatagaccataatttaattagctagtttcctatcaatgcatattgagggattttttattttcaaatgttgcaattttatataatgcttcaaatgttatctttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctcaaaaaaaaaaaaaggaaaaaagaagatatactgatttatattcacaacaactatgtaggaattaccctttcaattttgtgttgttatttagcttttcacatttaaatactttacctctctgactccgttgtaattaacccaaagacaggaactatgacattacatattagcatctctcacagtagttggtgctcagtaaatatttgttaaatcttgtgtatttagggagttttcccatgagtggcgtttctgatgagtcccatgtgagaattgtcccctttgcatgtttgctgtttccaggaaagggtgtgattgtgtgtgatattcttaggcgagatgcttagtctattttgtgttgctggagcctgggaaatccaatatcaaggtaccaacacgtttggtgtctggtgagggccttgtctccactcccaagatggcctttgaatgttccaccctctggaggggaggaatactgttcctcaaatgacacataagtgaaaagagaaagcccgcttccaaaggcacttttattttattttatttttattatttttatttttaatctttgtgagtacatagtaggtgtatatatttatggagtacatgacatgtttcgatacagacatgcaatgtgaaacagtcacaccatggagaatggggtatccatcccctcaagcatttatcctttgtgttacaaacaatccaattatacttagttatttttaaatgtgcgattaagtaattattgactatagtcatcctgttatgctatcaaatagtaggtcttactcatattttctatttttttgtgctcatttaccattttcaccctgcccctactaccccacaacccttgtcagcctctggtaaccatccttctgctctgtatgtccatgaattcaactgttttgatttttagatcccacagataagtgagaacatttgatgtttgtctttctgtgtctggtttatttcacttaacataatggtctccagttccatccatgttgttgcaaatgaaaagatctcattgtttttatggctgaatagcactccattgtgtatatgttccacattttctttattcattcatctgttgatggacacttaggttacttccaaatcttggctattatgaacagtactgcaacaaacatgggagtgcagatagctcttcagtatacctattttctttcttttgggtatacactcagcagtgggattgctggaccatatggtagctctatttttagttttttgaggaacctccaaactgttctctacagtggttgtactaatttacatcccccccaacagtgcataaaggtcccctttccccttttctccacatcctctccggcatttattattatctgtattttttataaaagccatttttattggggtgagatgatatggcaattttgatttgcatttctctgatgatcagtgatgttgagcaccttttcatatgtctgttagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaataccattacattggcaattaaatttcaacgtgagttttggggggaacaaacatttaacccatagcagacaccattcatttatatttttcttccaggatcctgtattatcattaactcagaaaggccaactaatccttggatctattatcaaatttggtttgtttgaataattaagtataaattagctaaatggaaaggctctcctctgtaagttctttaccatctttttatgatgaaaaattttaaacatgaatgcaagttgaaataatatgcccatatacctaccactgaaacttagcatttggtcgtatttattttgtgactcacatataaattatatttatatgtaaatatacagttaactttagaacaacatgggttttctaactgtgtgggtccacttatatggggatttttttctgcctctgccaccccgagaaggcaagaccaacccctcccctgccttcttctcagcctcctcaacatgaagacaatgagaatgaagacctttatgatgatccagtttcacttaatagtaaatatgttttctctttcttatgattttcttaatgacatttttgtttctctagcttactttattgtaagaaaatagtatataatacaaataacatacaaaatgtgtgttaatcaactgttattggtagggcttacagtcaacagtaggctattagcagttaagttttggtgggagagtcaaaaattgtacacagattttcaactgtgtggtgggtgggcacctctgacccccacattgttcaaaggtcaactgtaaatacatttatatttgctgaataatttgcaaagtaagttactgacattccatgaagcagtaagtaaagttgaaaattattttttgtaaaagtcaccatctaccttagctcaggctactataacaaaataccatagattggatggcttaacagaaatttatttctcatagctctggaagctgggaagtccaagaacatggtgctggctagaattattttggtcctggtgagggcctcttcctggcttgcaaatggctgccttcttgtgtcctcacatggtggagaaagagtgatctctgttcctcttcctataaagccactaatcccattatgagggtctcaccctcatcacttaatctaaccctgattatctcccaaagaccccatcttgaaatacttgtgggttagggcctcaatatgaattgaggggttggaggagacacaattctgtccacagaactttctgtgaacaagcctattattccctccctccctccctccctccctccctcccttccttccttccttctctttcttttctttctttcttctttcacaaatgttgtccctttctccaaaaggataagaagctgcttgatgcagctgtcaccagaacttctcttagtaagggaaatatccttaatgtctttttttttttggtggtggtggggaatatcttgataagtcatttaggtatgaacggtgaattcttatacagtggcacagcaatgtgagtttactaaatgcctgtgaattgtatactttaaagagggtcattttatgttatgtgaatttcacctcaatcaaaaaaaatgtgaccctatgaaaatggttggcaagaggagaggaagtgagagagatagctaaaccactctgcataaaagagaaaatgtgaatttgggaactggagaaaagcaaagggaaagaggcagagagtgctaacccagtggtgggagtctagaggaaaagtggctgacgggcattttaagaacagaagcgtttaatattcagttttaatttgcctgtctctgtctcctgaaactaataaagtcagtagacacaaaaataccttgtgtgaacagaattgtgcatgtaaacccttctttagactcacatgggacagaacacatacagccttatgctatccaggtgatccagaaacctcaaaaagtgaaattcaaaggcagagatggccaagaaaaaatgtaagccacttgcttcctcccagagtccgtgggcacatcaggagggttgtgggacgatcctcatatgagggatgtgattgaaccaacttttcctaattctcaaagtgtattgaactttccttgacatctcattggcaatatattgtcatttcattgctttaagggctcattatttactagtcatcaattgtacctgtaggggaatgcctctttttagagacaagagaccagacctccacagaggtagatcttggagattggagcagttctagaatttctaacatttccccttacggtcatcttgctaggttctctgtaacaaagcctggtagttcagaaatcaggctccaagaacgtgccatagatcaacctgtttgtgtgtgtgtgtgtgtgtgtgtgtgtgtgtgtgtgtgtgtgtgtgtgtgtgtgtatgtatttgggatcagagccactcaacttcctttttttttgaaacggagtttcactttttttgcccagactggagtgcaatgctgtgatctcggctcactgtaacctccacctcccaggttcaagcaattctcctgcctcagcctcccaagtagctgggattacaggcatgagccaccacacccagctaattttgtatttttagtagagacgaggtttctccatgttcatcaggctggtcttgaactcccgacctcaggtgatctgcccgtcttggcctcccaaagtgctgggattgcaggcatgagccaccacacccggccttcaactcaacttctacttagatggtggcagtaggaatcagagggagtggggcccctagggaagagcactcccatggaaaaagagtagaaacaaattttataattccctggttttcttacccagttctccaacctgctaaaatctgaaaaagtttcatactttaaatgaatggaagatcattagtctcataaaataatatgacactactgagctggcacttcggtgtatagaccaggttctatgccaagcacattctcatgtaatctgaggtaagcacagttatattccccatttaatagattagaaattaaagtttagagagactgtaaggttaaatgacttgttcaaggttatacatccttaagatgccatcctaagaatagaaactgaagtttgactataaaggctgtgtgcttaattaccatgtaaataaagtgtatccaactgttggagtttttttctacaaaaaggttctgctcatagcagatacatagtcaatattgactgtgttgaaggctgctttattcatttaaaatgtggcacctaaatctgttctgttacatcagccagacagtattttggccggccttgtgtcctcttgagtcatggttcattgccacagcactgttgtttctcctttgttaagtatttcagaggaaattctggacaaaggaaaggtatatgggtcttcaagtagagcagggatgtgttccagtagttgtcaactagactgagaaaacttggatgtcttacgaaacaatgtcagaaatccatttctgtgttctgtgactttctacaaacacaatttttaaaaatccaaatatagcttagaccatcagtagtctaattcagtgtttcccagatttgagatttcttttggaactttagaacgtcaaaatgaatcttgggacattgataagattgcagactttttattttataaattgattaaggatattaaacttgccactttcaatataaaaaattaaggaaggttataacctttgtgaaaaacttgctacatagttatttatctcatcaaagaccagtgaaaactttctcatagaccaacacttggaaactatcagtctaaataaccagtctatattcaaaaattcagtaaagatttcttcacttctaatgctcattgacttcagttatcttataggtggaaagaagtagatacaaaaacagatcttgattacaaaattcgttgatgacctagttgactctttccccagtcattactaatcctaacctttgggagcgaaaaatatctaaataagttctggtttacaaatttgcaaaatttttgtcaacacttcagaattcagaaaaaaacacaggacatttttactatataacttcctaagtttatatgatatatcaaaagtcagtaaggattataccataataatatttacatttcacagggaagcaaaatacttggagcctctccttgtctttgtctaaagatttgtcattcatttgcattcaaataaattctttgctttcattcatccagaatggttctcaatttattagctcatgagactacataaatagacttgtattcatacattttaatttcagtgtaaaatggctttcctcaatttttttttctactcaactctcccaaaagatgtctaatcactcccacactcagttacttaaacatttcataatgttgttacttctatagtaaaacaaaaagtaatttgcttttaataaatcagagagccctactgtagcaatctagaactttattctggcgagagcaaattctcaaattatatttccagcctcatttgtgaatagctgattttccctgtcacaaagcattgttaggtaggtacagtatttttctttagttggtaaactactggaacttacaatccaatggaggtgacctctatacaatacctgggacggtaataccctgaagcgcagggtgtggctattgcatgtgccacatgcacatgaggccatctgtgcgtgcttgttgaaagaatgacatatcttggtgagtaatatgaacattaaaagctctgctggataagctcatagaggtggggttcactgccttctgggtgagtggggaagactttgtgaagaaagcaacaactgaagtaaaattgaaggataaccaaagtagaaatgagaatgaaaggaagatactcctgtttggaaagaaaatactaacaatatgtacaggaaaatacaaggtatactttggagatgacaagtaaaaattttgccaggagcacagatgtaatagcaatttgagaagtaaagctgaagggtaggatcctgatgtagagaatgctggacccaggctgagcttggactttacatcaagtagaagtggtagagaaagattaattgcctctctgcattggactagtgccatcgtcttccaaaagctaaaaagaagcactttaggccttcaagggctagttatctaaaaaccacacttgatttgttcttaagtctcagctcctgggcatatgaggaactttttctggagttttggaaaattcctcatgccctcagatcctattaagacctctggcatctttttttttttaattatttaatttatttatttttattttttattttatttatttatttatttatttattttgagacagggtctcattctgtcgcacaggttggcgtgcagtggtgtgatctcagctcattgcaacctctgcctcccggactcaagcaatcctcccacctcagcctccagagtagctgagactacaggtatgcgccaccatgcccagctaatttttgtactttttgtagagacagggtttcaccatgttgcccaggctagtctcgaactcctgagctcaagcaatccgcccactttggcctcccaaaattctgggattacaggcgtgagccaccgagccaggtcaagacctctggcatcttaagagacttcctatgagttcctgcctccaaacttttttttttttttttttttttgagacagagtctcgctctgtcgcccaggctggagtgcagtggcgggtattggcttactgcaacctctgcctcccgggttcaagcgattctcctgcctccacctcctgagtagctgggattacaggcacacactactacacctagctaatttttctatttttattagaggcggggtttcaccatgttggtcaggctggtctcgaacttctgacctctggtgatctacccacctcagcctcccagagtgctgggattacaggtgtgagccactgtgcccggcctcctgcctccaaacttttgcacaaaccattcatgttgtttttctctttcccctccaaagcgtttcttctccctcaaaacctgtttccacactcaacctcctctagaaggacttacctgactatgacttaatgtaactgctccattactcaggaaacctatgctcaacatcttgatgctacatttaatttctctaaatgataaaatatacaaattcttgtatatttgtatgtctaaccaccctgcgacagcctttaggaaaggttccacatctgccaactcctttgtatcctccatccagaacctgcctcccatccctactttacccatccacctcagagacttcatggtacagtgcagtatacttggtgagtgttgatggtttaagagtgtgccctgaacaacgaaggatttctttgaggctgaaatcctgtgggatccatggaatgggagtttcacctgtctttggcttctgctcctttccccagcatgtgtagagcttctagaacagtccccagcaagagaggatcacttggtacacctctttcttatcctcactgtctccagtctctgctgtaggcctgctagtgatgatcaggatacaggttttaacatggccaagctgttaataacctgagattgggcaccatgaacaataagcattaaaaggcaataacaacaacaacaacataacctgttaattttatgcaggcttaattttttaaagaactatttcttcctaacttgcttttactcttcttcatctactttctcatacctatgactgacaatgataaggacacccacccactatacacacctaattccatccctccaaatttgatttcgtgttctctagagctggcgtgttatgtgacctattgtggggagaggctcagctgagggactctgtgatgccaaatggacaaaggcacacttttttctccaggtcccagcctggtgaaagtcatagcacctgagaatttggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgttggtttcgctccattttactgcctcagaatccccctgtgcatgttagtggttaatacagcagccaggagacgccagacagctctcggcacctggttcaaatttaaggctcatttacacatgatgtcacacacgcattgtcagcgcgagggaggtcaggatggttcattttgggaaggttcacattgttgagtctttacaacactcactgctattaatgctttaaccatctgacttggatttcggttttctggcatgaggtaatcccaggcactagatttatatgctgaatgggaagccagcaatggtggctaatcatgctggtttgcagatctgcacctctggagccttgggatggaattagagggccacatggcaagtagcaaatcataggcgttttgagcaggagaggaattagccagacctggaagcaggggccatagatggggtgttgtctgagccaggaagtttgattgaagaatggaaaccaaggtaaattggacaaggatctgggcccagagaccacaggaattattctactttgaccagtgctttgggtcattgcttgaactgtccttttgctcatcactcatagaaatcccagacccatcttcccaggtccagcgtaagtctttcatgttccatgaagcctttcctgaccacccatcccacagcaggggctgaggtggttagatcaccagaggtcagaagttcgagaccagcctgaccaacatggtgaaaccccatctctaataaaaatacaaaaattagctaggcgtagtagtgtgtgcctgtaatcccagctactcaggaggtggaggcaggagaatcgcttgaacccgggaggcagaggttgcagtaagccaatacccgccactgcactccagcctgggcgacagagcgagactctgtctcaaaaaaaaatttctctcctgaatccctaagtacttttgttactgagtacttaatttgtgcgactagctcattttaccctcacaattccaaagggaaggctttattatttctcttttacagatgacaagacaggttcagagaggttaaataatgtatccagtgtcaaacttttaaaagtcaggatggaatcctgattccaagcttaggttctgaaccactggggtaggctgtgtagtactacattttctgtggaacgtggtatcggtaacatgggagagacaggctgtgcctcaggaagatgccacatgggagtgcacagcagtgctgtagtgcctcgtgtttatgtgtagtcccaggtgcctggctgtaaacaactgcagggcagtgaccatcacctctgcttttctgcatccccacacttcctaacacagtgtcccccaaagtgtgcatcaatggatggatgaatattagcacccccgcaccaccctcacctaaaacatactgaaaagtttgagatctttggataaccaccccatcccctgctgttgtcttctgtcatacggctgaaatcgtaaaactggtctgcctgtcacagctccagtgagcctacttactcactggaaattcagagaatgtctttagtcctgttgactgctttgattttgttttttaacttgtaccaagacctgttgccatgatgggtctctgcaaatgggctttcttgttccatgagtctctgttttagtcaagtgaagggcacactccttttcattggccacctcttacttttcctccaagaggagtactcactcccagaaccctttgctgggctctcatgccgagcttaggtgccccttcagtgtgcttctgcagcactcattaccccgtagtagcattgtagtttaattcctgtttgcttgactgaagcagagactcacctgcagacgcctgtaggtgccttccacgttgctcagatgaacagtagagaagggtcaggcctgccctaggtttctacccctctcctcaaggccctttctagtcaccacgccacatcctgctcatgactgcagggatcatgcctctgggcctctgtccatgcagctgcctctgcctgcactccaggacaggggccttctctgctgtccactggagccctgtggaagggactcctgaccctagccttagggaagtcatctctaaaggctgttttattacagtgtttcctcagaatgaccctatagacacagtgttttctcagtgtcctctcacctttgaacatatccgggaataattgaaaaaaccaggcaatcaaatgtgcctctcataaatcaccatcacttcagagcagaacttaagagtttggtttgcaagccacaccaaatagtttgagcttggccctctaccatttcctcctgctctgagcccagaggttcacctagtggactgtagcaatggattcccttgcccctggcttcctgttgggttcagccagagagcagcaccagtgggagcctacagagggaggaaagtgaggtcaaggtgtctgctgcctcctccctgcctgccaggccactgtgggtagactacacctcaggtggccctccccatgtgtagccatgcttgccaggttctgggttctggaaacctccacctcctcttgccccttcagtcatagggtggtagcccccttcattgctattagctgttatgcactcaattgtgttccaaccccaaattcgtaggttgaggccccaatccccaggacctcagaatgcaactgtatttggagatagggtctttaaagaagtaattaaattaaaatgaggccattaagccctaattcaatgtgactggtgttcttgtaagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccca

SEQ ID NO: 1084 - DNA, 55754 bp, Homo sapiens
caataaacgtgttgggggcactgagtaatgtagccatttctgacccggcagccaggaaaatgtgaaacaatttgcttctggaaacaggacagccggggccgtgttcctgcaacagcagaccaagcaccgcggcggacccaggcaagcacggaacaagctgagacggtgcgtttaagcggcaggtggctactcagtgtcgcatactatgcggaaaataggtttggttcccggtgttgtggggcctgaagttacaaactttgggaagctcactttaagaaaaatagtacaacatttttaatatgaaattgccagggctttctctgggactttagatgggaccaggtaatttggaggccaacggctgaaactgctataatttcactgtaaattcactccttgctcaaaatctcagttagggaagctctcaggttgtttatgtatcaccaccagttctacctagctttgtgtgtattctctgctaattttctccatccgcttctttaggtattgcctttccatagcctttcatattggcctcataactgcttccaaagagacatagaaatgttccttataccttctttaactgtgtttttatgatgttactttagctacaaatatttgctcttaggttcctgaggtctccctaaatcaagtgctttgtgtattttagatggagatagacaggtgggagggaggtgaaccatgcagttgtactcatatccatataattttgaaagattttgtgggccacaatgatttcattggatttgaaaaggagtgcaactttgtggtccatgtaagtgcttctcaagctttcctgtgcacgtggatcacctggggatcttgctaaaatgaagatttggctgcgcgaggtctcgggtgggaactgagagtctgcatgtctaatgatcgcccggatgatgcaagtgcacggaccacactttgagtcacatccaagtatttatttgtaggaaatatggtggcacaaatacacagtcaataagggtatggttcaacctcattttatggtaactcgtctcaggatggaaagtctgcgacaaacctactatgtatggactggtgtttgttgacatggcaatacatgaggaggtcttcctgcctcccattttctcctatacccaggagctggggacagagggatgagaagtaaaattttatcattaaggatcattattatttcactgtctttagttttttaactttttatggtcctttttaaaactttgcctatggagtgatcagaagggacataagcttttagaatatctactagggtgttgggcattaggctgccattttctcttgactacttgtaacccttcgaagtggttattgtttcactgcctttacagatggggaagctgaggtttagctgggttaagtaacatgacagattccatagagacagagcagggattcgaacccagctcggtgctttcacttgcactaaccggcatcatgaaagcagtgttacatgtttaattcagcatgagatgctagctcatggatttattactttttgcttttctcctaaggaagttgcccagagagagtgccctaagcagaggagagggagcagaaagaaagaggttactgaaaagaagaaaagacttagaaaagctctatggggcactgaagattaatctcacacctaaagcaaaacttagctccaaaaagactagcattaagattcttgccttctttgtgagaaaatgatcttcccaaagtgtctggtttttatacacttattttggatcaattaaggtatgatgctccaagatgctgagaatttgactgtcaatgttaaaagatttctgtccatatcatgccaagatcaactttaactttccctctcctgcataacatcatgtgaaataaggatctgtcaggttctgtgaagccagtatttgtctttggccagcatcctaagactttttgaaccactttacttgatcctcagtcaaactttttgttcttgtttaaacctaccatcacattttgttcagttatttagcacgaagataagcgggcctggcatttggacaaatatttgaagatcaagtttgtcacagggccctccagtttcccttccagatcccaccccacttggagcgtcttccctttctttcccacccttcctgctctactgccctcccaccacatgtattattttaacatcttgacacctacaaaatctttagctatatggcatgtaaagtaagagaggataactaaaccaagtcaaagggtaaggaattgctatccttatctctgaattttaaaagataaatctttaaagacaccaccctgagccagtcagggaatacacttcctggttgagggaactatccaatggccacttaactagataaccctgtctcccttggtatcctgtttcctgctccccttctgtaccactgagaatttattccaacttttgaggttgtatgttcttacctattttcagaatgtggtttcaaattttgctatttaacactgcctttcagcaggagattcctatcgaaagattataggtaacatctttctgatatttccaataaaatgtctcttgcactggtctgttaagactcagatttatgggtagtttcaccaaactatgtcccttagcaaagctgtagtatgtttggctgaacacacagatatctcctactctgtttactgccatcatggagtggatggtgtacaggtatgacacctgaagctggctcccagggccatgcctcttaggtcactggttaacagtactggctaagtcacttaggctgctggggctcagtgttacatctgtaaaatgacttctaggtttcttataagatttgacatcctatgactgccttcctgtatttaggttagagcagtctctggtttaggagggtcacacagcaggcatgtccttctctagcattagtagcgtggtcacgaatatgggatgtggagttagactgccgggattcaaatctagctccacccactagcagtgtgacctgggcaatttatttatctattgcagctccataagctataagcagggaatgatgttacaacttactctatagggtgaatgtgtcacaacctatcccatgggctgggagtatcacaaaatatcccatagggtgggggtgttctggcctaccccataaggtggaggtgtcatgagctaccccatagagcagttgtgaccagtaaactctaaacagcctggcacatagtgagccctccttaagcattggctaggatcattatcataaaatcactctcatccttcaaagtctaatttcaatgtgctcccttctaaaataccttacttggctaccttaaggaaaaaacaacttttccttccttggacctttcatagcaaagtgaatagactctactctagcacctacatttttttccccatcttttcttttttaaaacatagttggtacccacaatgtgccaaatactttcaccataaggtttctcatttaagtcccgtaaagtaagagagttgttacctatctcaatttacagatcagaaaactgaaggttagtgcagggaaggggcttggccagggtgacacagtttacaaatgacagttctgtaacctcctccatgccttccgagtctgccaccccacagcaatctttcatattaattagttatgcagcccatctctcaaacttgttcattgtcactcagggccacggacagctgatctttatttctggaaccagtcactcaatgttggacacactgtaggctcaaaatcaagcatgccaaatagaactgccgacttgaacttcttactctcatgacatcatttccttataaatcctaaaaaactatagtgattataagtcatgttaattcaacacacaccttttatgtatgtaagaggttaacgaatggctgctggcttccttataggaaatactatattgatttctgccaggtttttgtgtctcctctgtgccttaatcactttctagtttcatctgtttatggaaataggcagcctgggctatttggtaagcaaattgataggtctattctatgtgggtggtaatatgagagtccacccagatcccactagctcttctatggaaatagatttcttgttaatactgactgggtttaggatctcattttactataaaaggttttttgtttcaccttcccaactgaattttccctaaataagcataagaagagcagggtttgctagttgttggacaggcatttgacttaacagtaagccctgtttatttattgtcacaatacgaggggggaagatattgcatttctaaaaattaatcatcagcaactatccttctatatcaagagagaccacagaaatgttttcaaattagaatttaggccatgtagaggagaaaggagaagtataaggaagggacagaagtaaatagaaggagaaaggcaagcccaagcctgagcagaaaccacatggtttatcttagaagaaactgatctggaaatgaaaaaagcttgagtcatcaaggtggggtccttcaagactgttaggaagcctcagtagcccagcttagggagtggagctttgaaggactgttcctcttggatgggtacctcaaaaacgtgtggcttcaggtgtttgttacacgagaacaacatattacggactcaagtgcacagtatgtgaacccatctttgagaaaataagcatatgtacataaatatttgaaaagaaaaacatctagagatgtgctgtgtttttcttttccctgtctgtatctcttggctttatagaataaacatatattgcatatgaatcttaaaatgaaagcaaaaaatgtataaagggcaggattttgaaatgaacaattatgttgaaatttcacaagttatatttcatcagatgcaacaacgcttgtaaacccttggaggtttactggagaaggtgcttgagggctcaataccttcctttttactcaatgttcttcctttcaatacacagaggcaactttgtgaatttgtcagtggtctctgtgactcatcttattaattttttatataaaattccaaaaattctcacctttagtgtgatgcacataaaagttttatttttcttttcttcttctttctttattattattaattttttttggaagacagggtctcactctatcgcccaggctggagtgcagtggcgtgatcctcctgcctcagcctccctagtagctgggactacaggtgcatgccaccatgtctgctaatttgtcaaaaaaattttctagagacaggatctcactatgtttcccaggctggtctcaaacttctgacctcaagcgattctccctcctcagcctcctaatgtgcaatatgctggggttacaggcatgagacactgtgccctgcctaggtgtgaaagttctatagacagaaaaatatgtataccagcacatagtactgggaaagactgaatagcaccttggacattgggatttttacatttttaatacagtgttgttaatgtcacaaatcaattcagcatctaaaaaaattaaaaagtaaattttctattcaactaatcagatctatttaattagcactctgctttgaggaatgatgtttcagctgtggatataaaaaattgacaagagttttcacagttttctccttctgcttcattagtaaaatacggaaatataaaaggcaaaagtaccctacaaccatgtccaatgtgatattgcctccccaaaggaggctttcactcaaaaaaagtagaccctcattgtttccataagtctccgagcaaattctcttccggccacagactttggatgtagaaaataagcttatctgggcaggtggatatgcagagtttgcaatggaagcaaagataaaaggaaggcatgctactcttacctccataggctctactctaccctgatctctgccctgtctttgatcactgggcaaagaaaccagtgaccatggcaaatagtacccattgtactcagaagaaacccattatacttttgtgaaagaattatcctttttaaatagctaaaacaatatcccagggaaaaagtaaccaagactttattatattgaatggataagatttccactacttctgtctaaaaatcaaataatgcccttggaggacattttaggaattaataaataatcttttgttctacatagtaaataataaaagctggttttcttaattccactttgagagttgtgtggtctatgttaggaggaaagctggctggagccaaccatggttaattcaatgccaggctgtatttcttagtctccctttcatttcactcttctgccatagtgggtccatcatactcccaggccagtgagaagtgccctctagtgattggatgggttcgcttggcgcccgcctccatgcagacagagcaatgcctgtgtgggtgcttcctgatcaagactgatgagtgggatgcaaatatcttctttttaatgcatgaccctggcatagccagagggaatatgagtgatggtgcctcaaagcagtaactttttgcttagagcttgagagtcaaagttaaggacccacatgtatacttcggctctagcgagtctaaggtgagtaaagccttcagattatcaataaagaaagattttaactattgggcatgtgaattcaaataacgatgcaatttcacaaagcaaagaagaacataagaaagtttgtttctctggcctactgctcaacattgctacttttcatgatcagacctgatattagactgagggttgaagtaactgtcttagtagaattagaaaattaatgcatttatttttcagaaataccttaagttttaatgttttacatgattttgggataaaaaggaagagtctttttactttgtaaatgtactcattttttcagttcttttaaatctcttttgatagcatctgttagtgcaccctcatacattttcctcattttatcttatcttaggcatttactttgattttaaattctcatagatattgaaaattatacctgtgtaatttatgttaaagatctggccatgatcaggggctgcaggtgttatttacaataatgtcagtgtctcatagtggtttgggtaatttggtcaaattacaggccgttacttcataaattgtgagctgtctggagttaaattttctgaagttttattatatccaattcaattcaaccaacacatatagaatgtttaaaaagtaaggagcattttgataaggtggtctggagaatggggcaaagatgatgaatttattatccacagtgggaggagtcaaaagtataaagtgctttttaaaaatcaacatatttataaaacccaaagcaaaggcagcagaaaaactgtagctattgtgtaatttattctataatcctacatcagtctcatttattaaaatcagcatttatattatcccttaataggaaatcgttgaggaaaagatatgaaggttaaagagaacttacctagatgctgcaaatactcattttaattatttattttgtttaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatggtgagacatcatgtgttccattatttttatactatttattatttttcctaagtctccacaaagtacttgatcataatgaaagaatatcaggtttcttaacttacactgtgaagatcctcttctatccacttatcacatgaccttttcttaatgaaagtataatgaattcaagataaaggattttaaaacattagttaactttactaaggcaaattataactttagaacagtggttctcaactgagggcatttttgctccccaggtgacattgggaaaagactggagatattttgggttgttccaactgggggataggaacagtaagtgttaaagacatctagtgagtagaggccaagaatgcagctaaccatcctgcagtgcacaggacagtcctcacaacaaagaattacccagccttaaatggcaatagtgccttaaaacaatgctagaaataagactattcctgtacagttgagaattctactatagtaaaaacactgaaatactgtcataagactgagccaaaatgaagatgctttgcagaagttaaatcttgattttcctgagtatattaaccacatggtaggtgatttgaaacacatttcaagataatcaaacaagattattaaccactggaatatatgtgtttgtgtccagactcaaggaatagattatgttgtcattggattttgactattacggggtaataggaagtgactctccattgcccaccccccaccccaatctccctctcaggcataacttgggctttatgcctttccttgtgcaccatgatgtattgcaggaagtatcttacattttgttttttaattcagaaaaggggcagcagaaaaggatccattgaaattaagaaaatcagatgtgtggagaaagtaaatctcgaggagcagacgcctgtagagagacagtacccatttcaggtaaagggaagaacgacattgcattgggtggatagttcttccttcaatttttctatcgtgaactcaatatatctaggaaaaataatgatatttcaaaataatctaaacaaggcttggaatattcccacatgggagttgggcattttgctaaaattctgtccaccaatctgccttccctggagggaagggaagggaagcaagacaggagcgtaagtcgcagtgacctgacctgcctcaggtctgatcatctcttttaacaaacattgctgagtatctccgatgtggtacacagtagtaggcatactatggggaacaaaacactgcccctaccccaaggcatttacagggaagtggcaaaatagactaatacacagaccattacaaagcagtgagggtgagagttaaggtggaggtcagcagaatgcatccatggagtcccaggatgtggaagtttcattcctcactccaagaggctagagagatattctattggaggtgacactcaagttgagaaggacaagtaaaatttaacccagcaaatatgagaaggacagtggtacaaaggaagcagcaggtgtcaaggcactgatgagtgaaacagtatgacacatttagagagcactaagtagtccctatgaataaagaagcccatgtgacagtgaaagagatagcctggagaggtgaccatgctaaggagttttcattttaccctgaagtattttaaacaatggtatggtatgtagtgtatgctggtagtaccttttggaagtggcctaatctaagtcatgccctacttttcttatagcataaaatcttacatttctgatccaaaggtagatggattgtctttcagatggcctgactacccagtgctagtattaggaacctgtggccaaaaatgaaatacaataatccagttgattaacaacccatacttcccatttggaaaaaatattaccaggccaggcacagtggttcatgactgtaatcccagcactttgggaggccaaggagggaggatcacttaaggctgggagttcaagactagcctgggcaacatagcgagacctcatctctacataaacattgttttcattaaaaaaattacccaattgggggaaaccaggggagggcatgctcatggaagatgctgcaaactcacctcatagaggcatagtgctcaaaagatcacaggctttggagcccccagagagttcctagttccaccacttatacttgtgcaactgtaaacacatactcaacttctatttctcacagagttgaaataagattaaaatactgaagtagctaggaaagagcccagcaactagtaagtgtttaacaaatgctgtgtatatttaccaacaagagttgaataaactagagaaggatctggagaagatattgtaatcttcaaacgtttaaacatttgtcttaagaaacagaaaagtatatattctggagattcctggggtgccacatgatgaaatagatgaaagtaacagggaaacatatttttactcaatgtaagtatgaactgtataatgatcagaatatatggatattggcagagatgacatagcagagtaaagaacattccatccctgaaggtatttttaaagatagagcagttaaacattttccagtgggctgtaaggaaatcatgcactgggtaggcaaatggaccagaacaatactaagacacgtgtaatgtctaacatattaatgtccatagtccagggtgtccctgatgagaactcagtgttcaccactactatgaggtacatcatcgctgtaattttccaaagtataggagtgtctgggataaaacaaattgataactggaggattttttaagaaaatttttttcatctaattccagagctgatgtatactgtataagcaaactcaaggtttcttttggatgacaaaaaatttgcaggtgcaccaaagtgaagtatggtgcaattatatataaacacaccaaatattttcctttccagattgtctataaagatgggcttctctatgtctatgcatcaaatgaagagagccgaagtcagtggttgaaagcattacaaaaaggtaattcaaaaaaagaaatgttgaaagagaaaggtcaaaaaaagccataaaagagagtcgttttttgaggcttggtggaggaaagacatggcagtaaaaagactcaatgccaagagacaatctactgattttcctaccaacctcagggaatgtgtcagactcatcctcatttttgctttctcattgttacatacaggaagcctgtggattggattccctggcccacacaaagccagtattgtgccttcccagcagcttaggggaagccaggccacctgctctccactcagtatgcttgcctttaccaggggaaagtctaggtcatcatggggctatgtcaagtcctgtagctaccacacttttgatgtttatagaaagttacatctaatacttatactgagcatttaccatttgccagctactttatcaaatgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatgggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaatataataatgattttaaaatttaaagaataatacatatgtacagagagaaagagatacagcagatgtggcaatcagttaataattggtgaatctaggtaaaaggcatatggatgctcattgtattaatcttattcttgcaacttttctgtacatttgaaaattttcacaataaaaagtagatggaagtgtatgtttattcaggccttttttttagaaccttttgctaaaatttagccccacccttccccttctgccacaagaaaacaccatgtgttgtaacccactcactttctttacagatatatctctaaaatcctaacatcaagctgatctgtatatgcattttactagttattttttcttcaaaaatgatatgtaattgtgttgttctcaacatactcatggttagacttttcttttttctttttggcttattaactgttgagtgaaagacctatatccttccggaaccatttgctcttaccttggttgctggccaaatggggtttttattgttctgtgataacagcacttactgaatgtttctcctcttggatcaacgtttgctaacgtcttgttttcttcctgtctgctcctcagagataaggggtaacccccacctgctggtcaagtaccatagtgggttcttcgtggacgggaagttcctgtgttgccagcagagctgtaaagcagccccaggatgtaccctctgggaagcatgtaatgtgtgattcctctgttggactggacgttgggtggatagtgctccattaggctaaacctgccagaggccagaagagcttgccagaaaacaagatgtgccagattggttggcatcatgaaaattcagccttgcagatgctatgtgacaaatgaaatctcattctagggtcaattgagtcatggccattaagataataacaatattaacatctgccattctttcatttcatgagaaacattttaaaaatttgaatcattaatcaagcaatgagctgttatttcctcccataatttttcttggttcaagataaactccaaaaaggtagaatatgttagatatgtcatcatagttcaaacagctaggtttccagtttggtaagaaaaccagctcgctcttcgtataaataacgaaaatcacaaactgaaaaaacaacattattaaaaaaaaaaaagatataacttaagtaacacttttcatcaccatgtatactaaaatgatggtcaaattttaaaatatatatttaaagcagttcgccattctctatatgtgtgttaatttcttaatgacatgagagaaggggctgctttacgtgaaatcagattctatccagagttgtactcccagggaaacaagagggacttatatgtatttaaagtttataattatttaacataaagttgttgataaatacaaaataggataacttattttggtaacagttttaccagcctggacaaaatatgcctggattacaatggctttaaagaattgaatgagatcagctacaaaatagaacttcatgaaatggaaaagatacaggcacataaaatattttttaaattcacttcatgacagtattgatacccaacaatcatgttaatgttaatactggtcattttacccccaaaaaatcaattaataaatattcattgtgttttccatcttaattagactatacagtgaatatttattaatctcaactagatcacattgctctatatactcatgaattatagttatttaatgaactatacagattggttgcacatgggtcttcgctccactgtaagggactgaggagtaatgtctccttatggtattaatcattttccccagtggttttgtctatggtctatttggtctattatcattacctagcaggtcagattccagctttgacaatgccctaactttctggaaggagcaggaaaaaggccagagagagcactgccttgggattgccttcctaggctctgtctggatgacactcaccatgtgttctgggtgccacaggtgctgtgcctctgaggaaaactacagagtgtagaggtgttgcagctcctgagcagctgtaatactgtctatctgtccaagtataatttattcccttggcttcttctgctgagctactgggaagtccatgggcataacaactaaaagagaaaaagttaggtgtctttatttctttttgtccaagatgccttgatccatcctctttccaggatacatggcctacataggagttgggccttatataggaaagctacagaatcactccagatgttgtgtctggattcacttaatctggagtattgctcacacaagctggttcattcttttaattcataacattgagtgtttctctttgttttgtttaaagttccttctgatattactttgttttaatgttcagatgctaatctgcatactgcagtcaatgaagagaaacacagagttcccaccttcccagacagagtggtaagtcaacattttaaaaatgtttttcatggtcaggatatattaaataaaccaagagttgccagattcaagactagaaaatgtggaattcatttagacttctcagcaaagagagaaaaaccatgagctctagataatagctatgggtggtattgaatagcggattcaaatatagaaccattgtaatatctcatatttttgcatttcattgttgtgtcttttcctagccagtaagcccataaatagtcaccaaaaaaaaaaaaagaaaaaatgggtgcatgcgggagatgtccttaagatggcatcacacataacaggcagctgttattagctgtcattctttccttaccatcaacatggccaagactgctttgtggaagtatcctggtgttgaaatgaaactctataggacaaaagcagaaaacaacataattctttccctccattatcccttcaaagctattcagtgggctttcttccctgcttccaaataaagtctttgccaaattccatagttttgcagtcattctcaaatgataaaaatgtccccattacttgtaatcataagaacagcctctgaattgttccatccaatgttattatcacatgactgcaaacatcattccaagttaaacatctgtcacctagcttgggcctgcatcacctggcagcatgcttttggggagggattttgggggggctgagattcatggccctttcagagttagttccaaggaagatgaggtctaattaaaaaaagacacacatagctgtttctatcatgatttggtggtggtggtatcggagtgagttttccagcactgattctttatctcatgggagacttttaggaatttcctactgaagggcagatccatatgtagttttatgacaggggagagatcttgatcctcagttcttggattttcagccctcaatctttcaagatggctgtcagccaactttttcccaagagtggagttggcctataagaaaacaaacaaaaccttgattgctctggttaattaagctgtatgtagctctctctcgaagtacaggctactgctgtctttttgctctactctcttgggttcatagccacagccttctgtttttagggttcccaggcaggtgtgagcctcctcaaatgccaggatacacaaaaaatggcttcccattggttctctggaagttcacctgaaagcaaggggacatctccgcccatctattggatctatggtgtcttgggtacttattttcagctacacacattcgcacacacttctctctttctaagtaaaagccacataattttcatgaatcaacatgaaagacaaaaataatccattattgtagtagactgaataatgtcccccaaatttcatatccatgtagaacctcagaatgtgaccttattggaactaggatctttgcagatgtaattagttaaagatcaagatgaaatcacacgaaagatgagagtgggccataaatccaatgactagtaagatgagaggacacagagagatacacagaggagaaggccatgtgaagacctaggaagagattggagttatgttaccacaggccaaggaacacctgtttcttagtccatttgtgctctactaaggaatacctgaggctgggtaattgataaagaaaagaggtttatttagctcaccgttctgcaggctgtacaagtagcatagcactggcatcggcatctgatgagggccttaggctgcttccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcaacataaaatttggaggggtcgaatatccaaaccatagcaacttggaaccaccagaagctggaagaggcaaggaaagattttatcctagaggcttcagaataagtatggcaatgctgaaatgttgattttgacttctagcctctagaactgtgaaacaataaatttttgtggttctaatccaccaaacttgtagcaatttgtcatggtagccctaggaaacaattataatcgttaggagttttactttgttattagcaacattgctgtttgggtttgaaaatatgtttcagtcctgaagcttgaaaagtatggccctctaaaacacctaggagaaacgcccagattaggcaaatctatagaaacaaagggtgatcagtggttgcctgggaccagagtagggatgagaattgactgcaaataggtatgaaggatcttattggagtgatgggaagactgggctgtggtgatagttatacaagttgataaatttacaaaagtcactgaattctgcactttaaaaaggatgaactaccaataaagtttgttttgacaagtctaagagcagaagataattaagagccagaaaccattgcatctagtctccagcagggaactttttggccaatatattgaaaattatcagctaggcaaatcagtggctaagggttcataagcctgttttgattataagcttcccaaatgaaccagggatcagagggtatcatgtaaagtatgtttttctttgttttgttttttatcagagtattcagtagagggcttattttctgaatggaggaaataaaaatcagctctctagttgttctgttcaaagagatttccttaaatgatttccatttaaggaacttcctagtgcatttttctttggacataacccacttcacagctcataaataacactgtcctgcataattaaaatttccagaatgtcaaagccttaactccaagtaaatgaaatttctgaaaaactaaaatatagcatgaaaaaaatattaaatgcatctctttctgtcacacacgcacacacagacacacacacacatattgtgaatttttaactgaaatataacattaacatagaaaagcacacaaatcctaagtgttcagcttgatgaattttcacaaactgaacaattctgtataatccaccctcagataaagaaacacaacatcacagaaccccagggacaccctgatgttccctttcagtcactactaccctccaaaagtagttgctaacctgatttataacatcatagattgtttgcctgattttgacttttatatgactggaattataaagtgtgtagtcatttattgtgtgtcttcttttcttcaatttgtgagattcgcttatttttttagtatgtgattatatttaccgtcatcattgtatagaattcagttgtgtgaatatacaactgttttggtttcttattactgttctaacaaattactacacaaatttagtggcttaaagcaacatacatttattctcttatagtttggaagatcatatgtctaaaatgggtctgcacagctgtgtttcctctggaagctttagggaagattctgtttccttgcattttccagttcctaaggggtacttacatttattggttcctggctccttcccctgtctgcagaaccagaaggttgcaggacctctactctctaacctctgcttccatcctcacagctctctaatctctgaccaccttatctcccttttataaaggccattttgattacatcaggcccacccccacaaaatccagaatagttgccccatctcgaaatccttaattacaatctgcaaagtctcttttaccacgtaaggtattcacaggttctgggaattaggacatgaacatattcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcatacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaaggtaatccccagctttcagacgggctgcccagcatgtagagtaaacactaccccggctgccctggacctcagcctcaaagctgttgatccaggtcttaggctgtcctctcagaaaatgttcagtgcttgagccagaagtctggggaagcagtggccccactggggctgagaagcatagattttccatttagattatccaatctaatgatctcagtaatgcctgatcattgtattcccttccctttctcctccttctccccccaaatatctccacattccagaatacagaatctttaaaaatctatcctttatatgaaagagcttaggatgggcttacttttgtaatgtgcttcagtatcactagccaaatggcaaatagcatttcaagcaaggccatggcttgccttcttggaatgtacaacctcacctctcctgacctgattagtcttctcacagtttttagcctaaagattctatctaaagccagaattgaaaattccttgaaggcaacatgtaaattgtgtatgtatgtatctcttggtatggcactgaatttgccctacacttgatgcccaataaatgttgaattgaattgcaagatgaccatatggaaagggtcaagtgactccccttccttatttcctgtctcagacctccttcctatcatgttgtctactctctgccatcttctcactcagttatcagcatccctgcagggaagtcatgtctgcctttccccacaatggatacagagcatctctctgactcaccatgtatctcttttcttagttatttttcccatgtccttttattcctttgttctttccatcttcatcatttttgcctaaagccaattactgaaagtttcaataatacagggccatatggaatttgaaataatgtaagtgtgttcttcttgattttttttcagtataataagccatggtccctttcattccaaagtggagctagaatcctagtgtattaatctatacctggtgcccaaggtatggggttacatttgtgcgcctgcagcccaccattcttgtggaaggagaggatcagtaaacccagttgcaaggagagtgaaagtcatgttaattgtgttccaggtccccttcctgacagaaactccagtgattcattgagagaggtgtgaggtgaagctgactgccctgttttcaaataaccaggaggaactgtcgattcacatggggttgctgccattattgagtttttgacactcctttagatttgcacctccttaggtttagtcccaactgtggattttccctagaacttcaggaagctagttattttaacaaaggattgattgatcacctcttagcatgagcagcattgcatctgcaagtaaattataataattgctaaaaggtcttcatggagcttgactttttaaagtgcagccatgattcttatctcatatatgggataatactttttatcaactttctgtcattcttacaatcttccctgagcttctttttaatctactttctgtttagtaagataatctatgcccccattaaatcattcaaatattacagaatattccatttacattcccctaaaatgttttctatgcacatgtggccatgtgcatacaaaagcaagtaagttctcacgatacagtctttgtcatttgttcttttcacttgacatcttcagcatttttcctatttgaatacatgaggatacacctgacttttaaaatttcattttcatttaattttggtgaaatatacataacataaagtttaccatcttaattatttttgagcatacagttcagtagtgttaagtacatttacattgttgtgcaaattgcctgattatttttaatgtctgtaagtaccagttgtatagatactaggtaaacctaagtgatgcactattgatggacattctctaagtgtttttagaaacaacaaggctaaataaaagctattctagtgggcaaggctctttgggaaggtggagagagaggcattttagagtttaagggctttatctaggcattccttgaaatagagccaggggagcatttccttgctaaggaaacttgtttctatgaactgtggttttgaaaaaagtctggactatgaaggcaaacaggaaataggttccacattccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttaagataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgtgaatcacaccacctcaaagatttcatggtaaatcaaattcagatatctcctacatccagaatatgcttccattttcaggaaaactaaccaaacttgcaataattttgcagctaggctttctacttaaggtaaatataaaccaaaaaagtctatgtagtttgcctctctgaaccctgaatggatggcttttgggttctagtttttcttgaactgactattcctagccagcatccatgacatacaccagtagtagcaccaacattagtatacctgacccaggcatctctagcaggaagaaaagcaacctagagttgaataactcttccataagaatagctatatacacaacccaatttttttttaacttgatactacagccatctctgaaggagtcttcatctatttcgtgagcccactctttggaaaaagtcaaagaaatataagttcttctgggggcctcctggggatctcctgtatcaaagaaccattctttcattaaaacttggcataagcccaacttttgagtgactctctctttactgttgctgtgttgatactttgccaggtgcagaaggagaaacctaacaatctaaatgttatttaggtggataaaatcagggtgggatttgatattgcatggctacgcacttggattatttcttggtgcttttctgcactcacgtttttctcaactcttcttaagggaattccctgagtcaagttcatctgaagaagaggaaaacctggatgattatgagtgagtattgaaagtcttctgggttcttctaaaattagacatagatacttctactctcttcctcaaagacattaaaacagatggctgagaccgtctcaggaggctgtatttacatgggtaaactcacgtaatgttctgggtcatttatctagatgacaggtgacaatgagctgggttgttaccaacgaaaatattttccccaaaactggattatctaaattggatgcaaatacttattggatttatcgtatgtccagcgtcaccttcatttcactttacctttgtagatgtagcatataatgtttctgctcattatttctttcctggagacctctaattaaggtgatgtttgaaagctcttattaacattgagtaatatttttggagaagttattaatgatgcagtaattttacagggtagcacaaatgagaccttgaacatggcaatatttatgtcgacagatctctattcttaggatgaccttgtcattttttttttttttttttgagacagagttttgctcttgttgcccaggctggagtgcagtggcatgatctcggctcattgcaacctccacctcctaggttcaagcaattctcctacctcagcctcccgagtagctaagattacaggcgcctgccaccatgcccagctaatttttgtatttttagtagagacagggtttcgccatgtttgccaggctggtcttgaactcctgacctcaggtgatccacccgcctcggcctcccaaagtgctgggattacaggcgtgagccacctcacccagccaaccttttcatttaacatcaaaattgggatactttagaaagagaaaaagtgcactattaaaaattatacccgttaataataacttaattatacattttaaaataacttaaagagtataattaattgtttgtaactcaaaggataaatgcttgaagggatggataccccataatccatgatgtgattattatgcattgcatgtctgtatcaaaatatttcatgtaccccataaatatatatacctgctatggtgagccgagatggcgccactgcactccagcctgggcgacagagcaagactctgtctcaaaaaaaaaaaaaaaaaaaaaaaacaacacaaacacacacacacacacacacaaatatatatatatatatatatatatatatatatatatacacacacacacacacacatatatatatacctgctatgtactcacaaaaattaaaataaaaattacacctggacatttgacataaactggacttctgggcaaataagaacgtgtggtcaccccaactatactgagaaggttggcctaagtggctattaaggttctttccaaaatctaagggtctatcattctacaaatagggacaaataattgtctcctagatgtaaagattagtgttaagaagaggtgggaataatagagcatattgcatttctcagacacttgataccaaatggcacagaattcacttgaacactaggattatgcatatttccagttctgtttttgtacaagtgttgtattattgatttattgattacatgtgaaacgagagcttttacaaagtacatgctactgttttcactcctcctctcatctctaacccagcctggtcctagccatacctgttgcattggggaagatgtgctgtaccctccacatctttgtggcatggtctctttatcaccttctagctctctttcggctttactttcttccctaacatctattctcaggaaagcattgatggaataattcatactaagacataaaagactgagaatgaccaacgcatggtcatttccaaagataattgcactttaatgaaacacaaagacttaaaccaatgggagtgaacctctaattgtggattgtactctttagcatttaaataaattagaagtctttccctgattgggtaagcccagatatgaccatttaaacagtctctattcccatcttttctgaatgcaagtggtgtgtgagagacagacattgaggaaattatcagggaagacttgtcctcttcaaaatcaaaaagataccaaaaggagctcgggattatagggctataggatctgggactcagtcacctcacattgtgcttaatgctcccagcttcctattctatcagtgtcatgggagtttttgttttatggccataacttcatgagcaattccagtcaattccattaaagacagaagcactaagccctgagatttagatagaaaatcgtgtgttaagactaggcctggccaggtacagtggcacatgcctataatcccagcactttcagaggctgagctaggcagatctcttgagctcagaagtttgagaccagccggggcaacatgacaaaacctcatctctacaaaaatacaaaaattagccaggtgtggttgcccattcctgtagtcccaactacttgggaggctgaggtgggaggatcacttgagcccgggaggtcgaggctgtagtgagccgagatcataccactgcactccagcctatgtgacagagtgagaccctgtcaaaaaacaaaacaaacaaaaaaaaaccttaggcctaggactctgctgctctgtcattgaatactgaaatattatttaaaacaataagaggcaggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatcctgtatcacagcccctgaagggccttttgattagctagtattaccttaaaatgttgactaataagaaaaacgatcagttaaaatttcaagtgttagttatacagtatccataatggtagagttaaaagagactttcaaacttatcaagatcaaccctctccctagttttacaggtagggaagtccaaggtcaaacaaggccaagtggcttgttcaaagtcatacaattacacatagggaagttatgcctagaacccagacctccaagctgggtgacctaaggctctttctattttattgagctgtccaccagctgacatcccttcccaaaactcatacagagattatacaaagaatcacttcccatccattcctgccaagttctgagataccttctacattgaatttctcctataactcctcccttctaccctcacccccctcttgtacttatttcctctgcagatgttatcttctagccagtgggtcctcccactcacccaaacccatgctacatcccacctcatgccctgcttttactcatttcctaagtaggacattctgtctaaagcccaaaggccacagacattattgccctcacatgagaaacagctcttggcctgttgagctccacatataaagtaaaagcatttgatgtgaaaatagatgttataatcagattattacaaggaaattatatgattggaagacaagagctttcatccttggcagccctgactttcctcttggaatattcttcataggtctaatctctagcccttactcaaaatggtaaaatgtaggaaaacttagaagtcacctagaagaaaaccaaagattcctaaatgccagcccatttaaaaattagatgtgcagactccaccccaacatcagaatttagtagtggggacttaagcatttgtatttctgaaaagctcctcaaatcattctctggagcagttaggcttggaaacccctgaggtaagccaatgcctcattttacagattagaaagttgagtgtcaagctatacaatctaaaacttattgattctcacatataatttttttccttttgcagctggtttgctggtaacatctccagatcacaatctgaacagttactcagacaaaaggtaaatagtcttgtctttaaaacagcctcacagaatctctttgcattttggggtccagaggttgatgcatttctcatagaaaccttcctgctaattatatagtcaagtcattgtagtgttgcttgtccagtctgtgggttgcccgactcttcatgtctagccactacttctgtgtccattatgtattgctgcataataaaccactcctaaattgggtggcttgaaacagtgggatttatgatatctcatgattctgtgagtcagctgggccagcagttcttaggcaagttttgcttaggggcactcctgtggctgcatttgggtcgtggattgactgggggcttgggtttagctgaggcagtcaactggagttccacagttcttccccaagcagtctctccatgtgcctcacttgggcctcctcacagcatggtgatctcaaggcagtagttgaagaggacgagccccacagtgcaagcacttttcgagtctctgcttttgttgtgtttgctaaggtcctattggtcatagcaagtcacatggctcagcccagagtcagtatgggaggggactgctcacagcatgaataagagagatgatttatcggaggccgtcaatgtagccattaacctcagctctgtcactgctcgttagcacctagaccagagtatagcagatgtgatacagaacatgtttatctgactttattactaattgatatggaatgccagtagcaaactcttttgatttctaaaaatgacactttgatatagtttaacctgataaaaacactaaacattacacttatttctttgaggggtgctagtgagaatgtaatgacttcatttggcgttttgtcacattcatagtttataatctgctctttctgaactttgatctgcttagaattagcacaaatcattgagaaagacaacttgagtatagaactttatcaactgatttattcttgatctttggttttctaaaaccttccaaaggcatgatacggtgatacacggttctaaattgtatttcttaaagatgaaaacattaggcttgcataagcacaacaccgagaaaagtaagtgatagggttaaatattaattggagaggaagagttcatacacatacacatacacatagagcagatctataaagagattgagtgagaaacctgtgccttttgtgatatataaagtcaatctaaaagatttgttttccaactacctaccatgcaaaatcattttcaagaatgatgaaaatattttctattccttctatattttccttccttttcagggaaaagaaggagcatttatggttagaaattcgagccaagtgggaatgtacacagtgtccttatttagtaaggctgtgaagtaagtatgatacggattaatttcttttctctttctgcgtatattctttgaatatgctggtcacaatcacattttgggataagacatcatctttaaactctggaattttaaatcaaagtatttctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaagcacttaataaactaatagtacttactattattgttgttgttgttgctggggaagggtagttctacctgctccactccctgtaccctaacacttgggcataaaagacaccccacagtcatctcatgcaaatcatcatcaaaatccttctccagagttttacaagccactttcttattggtagttagctctttttttttccttctaatcgtcctccaaagcaaatgggaaagctgtttttatttataccatattgcagatgagaggattgaggttcaaaaagagcttataaagacctacctggagctactaagtgactaatttgaagctgggcttccaatagccaagtcatgtttctttatctacacctctgtgtttacactgaacccccagtgttttggaatgagaatctggtcaaatattgattcggatcttcttttaaatttctatgtgtgcaactcttttttagcagctagattgaatgatcgtctgccttggtgccttccccatgtgccctaccccacagtgcatatatgtatatttataataattaagtaataaaaacgttattttattttgaaattttttacagagtgcctacctacacttgagataataggatgtacctgaattgtcccacagcactttccaatgccagaatccatgtccccagtgtatctcatatattattttgcacatggtaacacctggatgctggctaaagccaacccagtaagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcggttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtggtatctggttttctgttcctgtgttagtttgctatacagcaacaatttattaactgtttcttatatgccaggcataaccatataggtagctagcaagtgatagaactaaactcaaagcctggttcttgaccactatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcctgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatttcaagactgagaaaaacaccagatgccaagcctgagaaaacctccctgacttccctctccaaaatttgcaaatgcacctaaaataattatttaacccttgcttaatcaagctttattgtttattttaaatgttctaacattctttctgttactagtgataaaaaaggaactgtcaaacattaccacgtgcatacaaatgctgagaacaaattatacctggcagaaaactactgttttgattccattccaaagcttattcattatcatcaacacaattcagcaggtaacttattttagtttttcttttatgggcccttgttgtaaaacagcaattttcctggatactactgatcctcctaatattcttaattatatagggaaccatgaaagtaggaaaaaatcctctcaagtcttttgcctatcataatttttagcttacattcccaggaatataacatgattctctccttaatgccagaaagaatgaaattgagtaaactgggtgacttagaaagagaaattctctttataaaaatattcgtagggtttttctgtgtatagaagcaagaggattataaatttaaaatattatagaaatatatacatatcgttggatcatggaccagttgtctattatgacagggttttttgcatgctgccactagcacttactaatcattacatatataaatagaaattatatattatgtatatacattacatttttacagagatgagatcattctacacatattgctcagcttgctttctttactcaacatgtcttagaagtctttccacgcaaacacaaagagcttactttggtctatttaacagctgtgtagaattctatcatagttaccccataatttattcacctagccctctgttgattagcagttggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttctagaatcaccaagaagatcatcaatttgttttcttatcagaccccattattagcctccagcacaccattgtctgtcctatctttttcctggattttgtgcccactgagcagagccagtattcaaccttgtgtgttaggacgatcacatccactgcgatcacagtttaatttttttattaaaaaaatctgacaatgttttaccaatctaaggacatcgagtacattttgatgctaagcctctccaagatgcctctgattggcaaattgtttttactctgagccttcttgttaaataactgtagctacttcaagaatagtgttaccctggtgccattatcacgtagccacaagaccacatcactaagggtttttttttttaacttatcaacttaaaataaaaagtcttgtttatattgtcactgtgaaactcccattggagaagaaatcacttgggaagctgttagccccaaagctttctatgctcgtcctaaagaatgtccgtcttgccttgttaggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgtaagtttttcccaaggaatggctgtttagccctcatcatgggagggcattagcactaataggcctgctgttaactttgcaaggcctagagcaaaagtccacatactgtatcatagacataaatatttagaagttataaattgaactaacagactattaaatcaaatcagtcttatgctcctactttgacaaatataccttcataacaacctgaaaggccatattcaaattgagaattcccaagactctacaaagaaaccagcctctggcctgtggtcttccaaactccacccctcctgcttctcccctcatacccaactccgtcctgcactataaggggcctcagtagttatgtacagacacagcattcagtacacacaagctccctctttgtctcccgcaaacaattatctagtggctaatgatcttggctaggggtagtgtgctttacccttaagcggacagactccttaaggaagagtcagcacaggtcctgaaagaggcctcaggactatatggttgggtgatttcagagtcctggtgctctaagggtggcagagaaagggacatatagggtcggagtaggcatgtctccttggccctgtggcctccttgccctgtggggaggtgcatggtgggatgaagaacagagtggggctaccacccagaactaatgcagtactgaaaattaatgctctaccaacaatatccttttccttcttggtaccttcaatacagtctaatactcttcctaatgtgtctcagctcccagcacaacagccttcaattattggcaatacatatgtgttctctttccctctgtgtcttctctctctctctctcttccccctctctctctttctctctccctctctctccctcttcctctctctccttctctctctctctccctctctctccctctctcagttgtatataattctccctcttcttgtcaacatagtaaatcagactttgtagagtgaccaccattcaggtttgctgaggtctgggaggttttagcactgaaagtcctgtgtcctaggaaacctcccagccccaggcaaaccaggacagttggtcactctacttttagagaatcaatcagtatggtatgaaaaatgatgttatagtaggtctctggtcaaaaatagttgaaataaaaaaattcctagcctgctagagattgagagcactttttaaatttttacttaaacagttatactgtacagtgtttacaggcatttctctaagcactttacaaatattaactcacttaatccccataagaaacctatgagggttgtaccatcgttatcttagatttacaggaaaccgaagcacagaaatgttgaataacttgtccagagtcggcaagctagtaaaagtcgaaaagcagagatacaaacccaggcagacattctagggtccatttctttagttattcttttatgaagaccaaaggaattaggaaagtcagaacaatcacttttaccataattgcaaaattatttggaagcagagatgctatgtgaatataggcctttggccctagctggcttcatgggcatatgagatctgcacagttgcaagggcctagaagtacctagtacctagaaggtacctagaagggcacagtacctagaagggccctgtgcttggtttaatgctctgctgttgtcatcttgaagtaatacttcgtgatttttaaacaaggattcctgcattttcattttgcattggtgcctgcaattatgtaactggttctgccttcagtgattggactgtcataaaactgggaagggggcccctgatattctcctcttgtaggacaggaaaatctggcagaaactttctgccagatttttctcatggttacaggctcatgatgtaacctctgtgtcttggtgtaactttaaaacatatttttgccattaccaagctggtatccataaaaaaatcacaagaagtcatttaaaaacatcacctaatcataaagaaaaacgtcaaactgtgccacaatgggaaaaagtctaatcccaaatgtaggggtcaagctgaagcctatcatgtggggaatatcagttaatatggcgccctcaccttgagccacctgggcagtgactgaatttgttcaaagaatatttctttattgggtgatggacctttgtgccatcacaagccttccctctgaagggagcagtgttgagtaccatgcaggtctccaaaactgctaaaagatgaatactcccaagctcatcaacttgagtgacatgataagcattgtccctatagttaaactaagaaggaagaaaataactaaaaatttaataaattcttattaaaatatttaaaacttcacatgttaaatttagatttctttacacatttgaacattacagaataatcctgtaaattgttaaaattagattaatcatataagaacaagttaatgagcttgtaaaaactgagtgtcccttctcaaaagaagacatttatgcggacaacaaacatatgaaaaaaagctcatcatcacttgtcattagagaaatgcaaatcaaaacgacagtgagataccatttcacgccatttagaatggcaatcattaaaaagccaggaaacaacagatgctggagaggatgtggagagaaataggaacgcttttacactgttggtgggagtgtaaattatttcaaccactgtggaagacagtgtggtgattcctcaaggatctagaaccagaaatatcatttgacccagcaatcccagtactgggtatatattcaaaggattataaatcattctactataaagacacatgcacacatatgtgtattgcagcactattcacaatagcaaagacttggaaccaactcaaatgcccatcaatgttagactggataaagaaaatgtggcacatatacaccatggaatactatgcagccataaaaaagaatgagttcatgtcctttgcaaggacatggatgaagctggaaaccatcattctcagcaaactaacacaggaacagaaaaccgaacaccgcatgttctcactcataagtggaagttgaacaatgagaacacatggacacagggaggggaacatcacacactggggcttgttggggggtgggggataggggaaagatagcattaggagaaatacctaatgaagatgacgggtgcagcaaaccaccatggcacatgtatatatatgtaacaaacctgcacgttctgcacatgtatcccagaactcaaagtataataaaaaaaaaaataaaatttaaaaatcaacttctgcgtggcaacaaaacaaaataaaaaccctatgcaaactaaaagacaaatgataaactgagcaaaattatttgtaattcatattatggacaaaagactaatctccccaaaaaggctaatacctccaaactcattaacaactacactactgcactgtttgtttgtacaatggatcactcagagtcagctcagaatctaagagtaaagtacatgtcaatccaaaaatgtgtccaaattcactgaaatacaatgtagaacagaaaagaaagagtaattggagttgctaagtactttcaaaaggctttatgcttaaccgtgaagacagtaaagagagtaaagcagcagttcgggagcctgtctggagaagtaaaggtgatatggcagcacactgctagagactccgctagacatttagcttaacctatgcatctcacaaatggaaaaaaaaaaaaaaagataggtgagaaaagatatcatgagaaaggtaattaaggtagaagaatcacactttacaagaaggtttgcttgatttcttttaagctctaggctagtacaaaatttaagattgatattacttaaattaataagaaacactaaaggactcttcaattcgcaagattaaacacttccatctggaacatctgattactaaataatagcccatagctacattacgctccattttcttctacttaactttatcattttaaaaagggtgctgggaagaggtacggtaaaaccatctgccataataaaatgaaaattatctcattaaaaaaaaatctgagtgtccatgccatcatgacctaccagaagtgctacatcatatggttagtattttataaatttgttattcaaaaataatgaaaacaataatgtaaaataattttttaaaaaagaaaaaaaatcaaacctcatctgacttcatttagcctacattcttcgtattctaatatacttttttagaatgaaatatttagatgtgaaagttaataaaagagaaatgattgttcttagggtgtggcttcctctaaataagtcatggacgttcccaggatgccatgagactcaacagggtttccagtgcaacagaccattgctaccctgattctctgtaggaaagttgaatacagcattcacaaactgctaaattgctgctgaagtcaccaatgtctgatatgaggcagaaattttttttgcctccaaagataattgtgcttgaaatataagatcctaaacttttccctctctttctctgttcaagtgaaagagggtgggggtgggaattaaaacaaacagaaatctgagagcaactctttttcagtacatgtagaaaatggagtgtggagcattgaactttgaaaatctgttatttccaggaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggtaagcaaagccattggaatttcaaagaaaagaaagcagtccacggctcccacttctggagatggggtcactggtagggaaggcaagaagggcaccatcacttctactttgctcacttgtgacttgtttaagcaaatgacatttttacaaaaatcaatgtaaaaatatttgaagtatggaaagaacagtgagaataaaataagctgttaaggtctacatagctgtgttgtggcaagaaggagaacagatggaaaggaaagacttctgccaatttagtgtctctcaaaaccattaaacccaaattgaccttcatttcaggaagggcttagtgctaaagcagccatttgatacaataactgaacatgaaaaaaaaaaaaggaaatagaatttgtgtgtctttggatcagaatgagagtggggaatgctgtgtttggtattcactgggatttatctttagagattttcttgcgctcaacagtagacctgcattcacactaggccagtgtgttccctaagtcacaggtgcagcgtttatgccttcaaagcatctgtgaatgcacggtatctggtggtggaaagggagattctagaaatttctcatctttccttgataagctaaggttctgtgtttaaagtgtaataccttttcatgttgtttgacaaggatggatgcttggttgaaagtactcatgggagaacatttttattttgaaaaattgaaaattgcaaaggaaaaaaaagacaactttagagcacttgggggttgtgctaggtaatcttagattttgctgagaattctactcaaaaggaggaaaatgtcaggagattcttggtcactttcactacttggtgattttgtttttcctttaaaggctgctcgtaactgcttggtggacagagatctctgtgtgaaagtatctgactttggaatgacaaggtaagccaattccgaaagggcaaccagtgaaagggggatttccattcacatttgaacaccatcataattgaaggctttgtggggatatagaaggtgctctgaattgggggcttagaaacctaagtccctcccatgggattgttcttcagaaattatctgacgtcacttttagttctttcaacaatctgatactttctaaacttctaaataaattccatgaaagatcctaaatttaaatacaacatgttacagccacattattggattgttttactttcttttaaatttttttatttttaatttttgtgggtacatagtaggtatacatatttatggggtacatgtgatgttttgatacaggcatgcaatgtgaaataatcgcatcatggagaatggggtatccatcccctcaagcattttggagtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggcaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagctaccgtcactccaaccaccatacactgagtcccctacactgaccctccaaacatgtagctttctcaagagcaagaaaaaaaaaatctgctgacaggttcttaaagcagggagaagctcccaggtcaagggaactgatccccacctttactctaaaagcaagaatattggctgttatgccagcatccagggaacatgctttcacgttctctgtagctttggaaaagggagacttttccaaaaaaagatccaaagaaaaaagagatcttgctctgagtaagagatcctggaagccatgtaccagccctgttggttatgaagctctgtggccacatcaattagatgcctgtgacttcatttgctcctactagcttgaaggaaggtttaagccatgagcatccccaaaccaggagtgccagggtagtgtctgggtatctggtagtgtctggggagctgaggggttctggggagaaaagtatggaatgtactgtatgtaatcctatgaaagtgtagtttattaatattattgttaatatttagaaggatgatcttcccagccagctattttaaattacagtgagatctctaaaacatttggtgtgtaaattatatccaaaattccaattgccataactcctgttgttctattttctctaattaagagtcattatgtgtttgtttttgttgtggtttttgtgggcaaatatatgatgttctcttttattaatactataaataatatgtacttattataagaaaaatagcattagtgtagaaagtaaaaagtagaattgttagcagcagtgaatccgtaaaggtctgcagcaactcaattcttgcctcctcaaaggaaaggattcatctgaggggcataaggcagagagagagactgaggcaagtttttgagcaggagtgagagtttattaaaaagttttagagcaggaaggaaaggaagtaaagcacacttggaagagggccaagagggcaacttgagagatccaactgccctacttggcccttgacttagggtttcatacattggcataattccaaagtttgcatcttttctcccctgattcttcccttggggtgggctgtctgcatgagcagtagcctgccagcacttgggaggggccgcacgcacagtgtgtttacttaggttgtgcgcatgctcatttgaggcatttttcttttaccagtcgagtattcttagaggaaggtcatataccagttaaactccattattttgcctcttattgcgcatgtttgaccccagttgcccaactcctgagatcatatcaggaagctgttgatcatcagcttcaagtattttctatctattgggagactgccgttccctggcaccagctgcgaccaattattattttagagagacggttaacaactgcctgactattacctgacggtcacctaatattcctgggttgggggtgggggatctctcctgccctgctcatgtctgcctagctacctattctgacagaatctgtccctcattttcagtgctaggagtaaccactgctcagatgtttggtgggtatcctttcagacctcattcttaagtgtatccaatcatatacacaaatatgcacatttactacttgttcccacacacaaaaaatggaatcacattatacacactttcttttgcacataaccatataccatgagcacctttttattttggtgaagagttatctcatttttgaatggctatgtgctattctattgtgtgagtgtgccataatatatttaattactcctcaacattgggaacattgaggttgctttcattttatcattattacaaacaaagagtttagtgaacattcttcaacatgtattttggtcttgatatctccataggatatttttgttcatcattattcataacagcagaagattagtagcaatttacctggttaaataaattatgtttaattccttccataagaagaaataataagagggaatggtattcagccactaaacatgatgctgcagtagaaatgtaaccgtatggggaaatgctcatgatataccattaaaggaaaaataaaagcaaatctcaatataacagaaaccctattttgttcaacttatatatgtgggaaataagatcagaaagtacaaagaaaaatgtattttgagtgatagaattacaggttatctttagggtgggtttctgagtaattttatctttacttttttgtgtttttctatatttaccaaacattttgcattgaggttttgctgtattcagttagatattatcttttaaatgcttacaaaccataagcagcctccagctaagcccacacattgaaaggaaacaaaagttccagaaaactgaggcaatcgactgagactctgggtggcttccgtgtccttcatcagcctgtaccaccacggcttaaggtctgtgttgatgtgttttccctggcaggtatgttcttgatgaccagtatgtcagttcagtcggaacaaagtttccagtcaagtggtcagctccagaggtgtttcattacttcaaatacagcagcaagtcagacgtatgggcatttggtaaggatgtggccacatacgacctggccctgtttcataagcttacttccacaacaggaaaccacaagagtagcaatgtccattttaaaagggcccttgaacacttacgaagttacacatatagcctgagagaagcaagctgttgaagaaggtgatttattttcttgggtttggtattaggatgtcttctacacatcttgtaatttacatcctgctagcactttctcataaaatcaaaagggataaatctactcagaggttgaggtggaaggattgtttgagcccaggagttcaagtccagctggggcaacacagttaagaccctgtctttagaaacatcaaaggggatgaaagtttttccagtgaagatttcaaataattttttaaaaggagtcattgaaagctgaatctgagtttttgctgagccccaaacgttgaaaagacatcaattttctgcatgaaaataatgggatagccattcccttctgcgctgaccaattcttagtgtaaacaccacacatgacttggtactttctttgactcgtgcctagtttcaagtagtctcctctctgttaaaatttatattttagattgggattggcaaaccacagcccaggaccaggtcagttggtttttgtaaataaagttttattggaacacagtcatgcccattcatttatgtattatctatggctcattttgtgctacaacagcagagtagagtagttgccacagatactgcatgtcccaaaaagtctaaaatgctatgtggccctttataggataagtttgctgactcttattttactaaaatatctatattaaaatttagtaaaggtcattagaaaagggaaacaattcttaaattgtgactacattttatgatattttttctatgttgtgagaatatcaaggctattttcaatcactgtcggatggacccaggataagtaatccaaatgtgactgagacctatttcatgccttagttcataagtgtaatttgatttactgcttgtcacctacaagactgcctttgaaaaggggaaaatttagttatttatttctctatgtgacacaatttttaaaactaactattccctttgtaaaagtggcattgttcgttgttaaaaaaaaagataatcaaatacacacagaaaaagaaaaaaaatcacaaagatagcattttggtgaatacttgatgccatgttgtactgattaacttttgtaccttgttgtcaaaattagttttgaggctgagtgcggtggctcatgcctgtaatcccagcacttcgagaggctgaggcgggcagatcacttgaggccaggagttcaagaccagcccagccaacatggcaaaaactcgtctctactaaaaacacaaaaattagccaggcatggtggtgcgcgcctgtaaccccagctactcgagaggctgaggcacgagaatcgcttaaacctgggaggcagagtttacagtgagctgagattgtgccactgcactccagccttggcgacacagcaagaggctgtcttaaaaaaaaaaaattagttttgataatcatgcatcaattataagtgatagcaaaaaatcaatgccctaatttaataattacagcttgtttttgaccaaaaaatagtattacccagcttgattatttaccgtatgccatagaagttggccccagatattttccagctgtttataaacactaaattcattcttaaacaatatatcccagtgaggatacccaaaatgaatcagggcctctgatagcaattcccaaagaagaaccccacagatattttgaaataagtgtgtagccttccaaagagaaagttatgaggaaactgcattcttttggattgttgttttagactgtgtgatttaaaagaaaaaagcagccataaaatttataaggttgctttattataaatatttgaaactggctgactgttgaaattttctgaccttggccagcacagcacaactgccaccatttagagagcacttgaaacatctcagtgctcttttaagtgctttacgtgttttatcctatttaatcctcacagcaagtccatgaggtgcaaataccccattttatagacggagaacctgaggctgagaggggttgagaaacttatcccacctgtaagtgacagaagtcaacttcaaaggccatgtctaactgatcccaaatgccatcctcctgaccaccatgaccagaaccgagatttcttaacctggggactgcaatttcctggatgagttttgggggactgtgaacatcctgaaactgaacacaaaaatgctgtgtattcactttcccaaaggcggccagtggctttcatcagattcccaaaagggtgcctggcccatatgagattaggaaccactgcagcaatagaaaggagaatgttgtcaatgattttatcttgaaatttccactgaagtgtaatctgattgtgcaatgaaattgttgcatgcagctgccaaagccgagagacggaatgggtgaggacatcaaccactcattcataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaactggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcacatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggagacattgtaaaagggtgtccaggtgagaacagcacaagcaaaggtgtggaggcaggaacgagcatggcacgctaggctggtgctatcgttggaagggctggagataagtttggaagagtaggtctggttcaggttctgcaaagtgaataacaaggagacaagtgagagttttggtttttgtaggcgatgaggagccactgaagacttttgagcagtaacatgataaaaggaggcttttgagaacattattctaagagcccatgttcataatcattatatggtacttcctcaatggcaaagggcctaatgctgcattcatttattcactagtaaaaggcaaattggtgtaatggttaagcctgtgggttctggcatcagaatacctgggttgaatcctgtcgtgatcacttactagttatatgaccttgtacaaacctcctattattatctctgtgcttcactgtaatgtaatgcttacctcatagaatttttgggtggattgaatgaattagcattataaaggccttaggacaatgcctggtacacagtgctgtttttctgttattaatattgtgtgtgtgtgtgtatatatatatatatttttttttttttacaaagcatctatgcaccaggcagtacgcttggtgctaagaataaattgacgcacacaacttaaatagtttctaaactcttgtaccggagcctagagtcccactttggaagagttgctgattgcatcacataacaatatttttcgtttagccttaaattatcacctggaatatgagcactctgtaatttcccaccctatggcatttggaacagtatataaggtttccacacctttttctaccccaaatgttgactatgggaactatggatatggacagagatatgcagactacagtggccaacagagcacttatggcaaggcatctcgagggggtggcaatcaccaaaacaattaccagccatactaaaggagaacattggagaaaacaggatgagatgttaaagtaacccatcttgcaggatgacatagaagattggtcttctgttgatctaagatgattattttgtaaaagactttctagtgtacaagacacagtgtccaactgtatatggctgccaattagttttctttgtttttactttgtcctttgctatctgtgttatgactcaatatggatttgtttatacacattttatttgtatgatttcatgttaaacttcaaataaatgcttccttatgtgattgcttttctgtatcaggtactacatagctctgtaaaaatttaaagtaagcaataattaaggcacagttgattttgtagagagtattggtccatagggagaaactgtggtcctttataaatagccagccagggtcaccctcttccccgatttgtagatgtattctatgctcttaaggtttcatcttctccctgttaactgaggtttctaccacacttttgaataatgttctttcccctctggttatctgaagattgtcctgagaggaagacataagtgttgtgattagtagaaactttctagtagaccatgtttcttctggattgtaataaaattgttagtagctccttttgctttgttcctgtctctagaaagccatctttgaatcgttaattactttggctttaatcagtggtcacctagaaaaagctttgtaatcataacaccatgactttaattcttgataaaaattcagatgcacacaggaaggagcactgtaaaactggtaggagctatggtttaagagcattgaaagtagttataactcaaggattttggcagaaaggtatgagtttggtcaaaagttagattaaaatttgaaatagcggcaaaataagatttagttgtattttgttttctcacagccaccacaagactgaacaaaatattttctgtttgggcattctgaggaagctgtattacagttaactgttaatgctgtgtgagtttagaaaaagtcttgatagtaaatctaacttttaacacagttagtgcatgaactgagtagttaaacatttccgtattcagacaggaatagtggaaaaggtatcttaggtgcgttactcaatccaaatgtgactgaatcattacagtggaccctcatggtgcattgaaaagaaactgttttatatccaggtttcagaggacctggataaataaaagctttggattttgcattcagtgtagttagttggattttgggacctttgcctcaatgttagctactgggattggcatatgtgttcacaggcagagtagttgatctcacacaacgagtgctctcacaaaactggtgtaagtttcttatgctgatgagcccccgcttttttttaatttggtgcctacaactttgttacaatgattgtacttgctgggctatcaagttacaatgctcttggtcttttttgctgctgtttcgctatttgtccttacacctaggccaagtaccaatgttagctgttggaagggattctgtttattcattcaacatgcaactatctaactttagggaatggaaggaagttcatttttaagttgtgtgttgtcagtaggtgcagtgtctagggtagcgaatcctgtaagttcaaatttatgattaggtgacaaattgacattgagattgtccttttccctgattaaaaaatgaataaaggctttttaaagaaacaaacaaacaaaaatattgtgtctaagattatcaggcagcactagagggtcagactgggtctgggtagagttggtcacagccaggctgacttactgctgtcacctgtcagatgaagaagagcagacaagggtttttcagttgaagcccagaacctccctggccctccctactctagctcctgggaatatgactgcaccataggatggacaggggccctgagtcgggaggaactgccttcttctcatggttggttcataaaagcatgtgaattgtggcagaatctgtgaagaggggtttgcactgagacgacaatatccagttaaaacattgcacctaatgagcagagcttatagatttgggttttccctccttttttagattttattttgtgactttctcaattcataaagagattgaaagaacattcacaattttcattagattttgattcatccttctggtatttctgtatgcaaaaacaagcatatgtatagatgtgtgttttcttgcttccctttctctcttacaaagaaaaagtagcatatgaacttctcctctccataggcgttgcctcactagcaatgtaagagggtacctattttcttataacctcaccaatggagtgcattgtcaagcttttgaagaattcttgccaatctgataagtgaaagcttgatggcatcttagtgcagctttaatatatatatctttcattatgaggttgagcctcttttcacgtttttaagggtcattttgtgtctttctgaactgtcatgtcttttttcttttttctgtcaggttttaaagatctctttacaaattagggagagtaatactttaagttatcagctttatttgattgagggtgggtgggtttttttttctttttttgaccatgcagaaatttttcttaatatagctgaatatatcaatatttgttttcattgcttctggaaattgtcatagataggctttctcatgcccaaattataatgacttttgccaggattttcctctagtacttttaagattgcattattttccatttatgtttctgatatagtttgtgtttgttatggtatatggtattaaatatggctccaaatatataattttatgtgactattctgttgttggcagccctatttattaaaagaccatcttatcatcaggaatgagataccaccttaatggtggtgaaatgccaccctaatattatactaaatttccatatgtacttgaatctatttggagacttcctcttctgttctttggtctctttgttcatgtgctagcaccacactgctctgattctgtagagactttatgatatgtttgaatactaggtaggctagcacccctcattgctcaccttactgtataatttcttagccatttttacatattttttaattctataaaccaaagaatcaatttgtttagcttgaaacaaactcattcatatttttgaggagattgtatttagtttgtattttaagttgggaaatttgacatctttatgatactgacttgtcctagtctagaacgagggaagctttttttttttttttttttttttttaagacagagtcttgctctatcactcaggctggaatgcagtggtatgatctaggcctactgcaacctccaccttccaggcttaagtgattttcatgtcccaccctcccgagtagcttggactacagttgtgcacaaccacagctggctaatttttgtatttttagtagagacagggtttcgccatgttgttcaggatggtctcgaactcctggcctcaagtgatccactcacctcagcctcccagagtgctgggattacaggcgtgagccactgcgcctggccagggatgcttttttatatagtcaagtctacatttgcatttttcagcagtgttttaaagtcgtccccattttagaggggcacacttttttagtgttttattttggtggcgttgctattataaatggggttttctcttacatgataacttctaagtggttactgtaggtatatgtgaaggctattgattttgtatgttaattttatatcctgctctcctagtgaattcctttattctttaagtctgttctaacattgatactctcagattttccaggtatacactaaaatgcttgcaaataaagagactttttcttttccagttattggggctctaattgttcttgctttccaattgcattggttaacaccttcaacataatgttaagagtgattattatagtgagcgtccttgccttatttctgacctcaattgaaatgtctgttgtgtttccacattttaaaagttgctagctttaggacttagatgtaaatattttatatattttatcattgatcataactctcatcatctaaaacattgggtttcttgttgtttttgtttagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 1085 - DNA, 49223 bp, Homo sapiens
agggaatatgagtgatggtgcctcaaagcagtaactttttgcttagagcttgagagtcaaagttaaggacccacatgtatacttcggctctagcgagtctaaggtgagtaaagccttcagattatcaataaagaaagattttaactattgggcatgtgaattcaaataacgatgcaatttcacaaagcaaagaagaacataagaaagtttgtttctctggcctactgctcaacattgctacttttcatgatcagacctgatattagactgagggttgaagtaactgtcttagtagaattagaaaattaatgcatttatttttcagaaataccttaagttttaatgttttacatgattttgggataaaaaggaagagtctttttactttgtaaatgtactcattttttcagttcttttaaatctcttttgatagcatctgttagtgcaccctcatacattttcctcattttatcttatcttaggcatttactttgattttaaattctcatagatattgaaaattatacctgtgtaatttatgttaaagatctggccatgatcaggggctgcaggtgttatttacaataatgtcagtgtctcatagtggtttgggtaatttggtcaaattacaggccgttacttcataaattgtgagctgtctggagttaaattttctgaagttttattatatccaattcaattcaaccaacacatatagaatgtttaaaaagtaaggagcattttgataaggtggtctggagaatggggcaaagatgatgaatttattatccacagtgggaggagtcaaaagtataaagtgctttttaaaaatcaacatatttataaaacccaaagcaaaggcagcagaaaaactgtagctattgtgtaatttattctataatcctacatcagtctcatttattaaaatcagcatttatattatcccttaataggaaatcgttgaggaaaagatatgaaggttaaagagaacttacctagatgctgcaaatactcattttaattatttattttgtttaggatgataatatggatacaaaatctattctagaagaacttcttctcaaaagatcacagcaaaagaagaaaatgtcaccaaataattacaaagaacggctttttgttttgaccaaaacaaacctttcctactatgaatatgacaaaatggtgagacatcatgtgttccattatttttatactatttattatttttcctaagtctccacaaagtacttgatcataatgaaagaatatcaggtttcttaacttacactgtgaagatcctcttctatccacttatcacatgaccttttcttaatgaaagtataatgaattcaagataaaggattttaaaacattagttaactttactaaggcaaattataactttagaacagtggttctcaactgagggcatttttgctccccaggtgacattgggaaaagactggagatattttgggttgttccaactgggggataggaacagtaagtgttaaagacatctagtgagtagaggccaagaatgcagctaaccatcctgcagtgcacaggacagtcctcacaacaaagaattacccagccttaaatggcaatagtgccttaaaacaatgctagaaataagactattcctgtacagttgagaattctactatagtaaaaacactgaaatactgtcataagactgagccaaaatgaagatgctttgcagaagttaaatcttgattttcctgagtatattaaccacatggtaggtgatttgaaacacatttcaagataatcaaacaagattattaaccactggaatatatgtgtttgtgtccagactcaaggaatagattatgttgtcattggattttgactattacggggtaataggaagtgactctccattgcccaccccccaccccaatctccctctcaggcataacttgggctttatgcctttccttgtgcaccatgatgtattgcaggaagtatcttacattttgttttttaattcagaaaaggggcagcagaaaaggatccattgaaattaagaaaatcagatgtgtggagaaagtaaatctcgaggagcagacgcctgtagagagacagtacccatttcaggtaaagggaagaacgacattgcattgggtggatagttcttccttcaatttttctatcgtgaactcaatatatctaggaaaaataatgatatttcaaaataatctaaacaaggcttggaatattcccacatgggagttgggcattttgctaaaattctgtccaccaatctgccttccctggagggaagggaagggaagcaagacaggagcgtaagtcgcagtgacctgacctgcctcaggtctgatcatctcttttaacaaacattgctgagtatctccgatgtggtacacagtagtaggcatactatggggaacaaaacactgcccctaccccaaggcatttacagggaagtggcaaaatagactaatacacagaccattacaaagcagtgagggtgagagttaaggtggaggtcagcagaatgcatccatggagtcccaggatgtggaagtttcattcctcactccaagaggctagagagatattctattggaggtgacactcaagttgagaaggacaagtaaaatttaacccagcaaatatgagaaggacagtggtacaaaggaagcagcaggtgtcaaggcactgatgagtgaaacagtatgacacatttagagagcactaagtagtccctatgaataaagaagcccatgtgacagtgaaagagatagcctggagaggtgaccatgctaaggagttttcattttaccctgaagtattttaaacaatggtatggtatgtagtgtatgctggtagtaccttttggaagtggcctaatctaagtcatgccctacttttcttatagcataaaatcttacatttctgatccaaaggtagatggattgtctttcagatggcctgactacccagtgctagtattaggaacctgtggccaaaaatgaaatacaataatccagttgattaacaacccatacttcccatttggaaaaaatattaccaggccaggcacagtggttcatgactgtaatcccagcactttgggaggccaaggagggaggatcacttaaggctgggagttcaagactagcctgggcaacatagcgagacctcatctctacataaacattgttttcattaaaaaaattacccaattgggggaaaccaggggagggcatgctcatggaagatgctgcaaactcacctcatagaggcatagtgctcaaaagatcacaggctttggagcccccagagagttcctagttccaccacttatacttgtgcaactgtaaacacatactcaacttctatttctcacagagttgaaataagattaaaatactgaagtagctaggaaagagcccagcaactagtaagtgtttaacaaatgctgtgtatatttaccaacaagagttgaataaactagagaaggatctggagaagatattgtaatcttcaaacgtttaaacatttgtcttaagaaacagaaaagtatatattctggagattcctggggtgccacatgatgaaatagatgaaagtaacagggaaacatatttttactcaatgtaagtatgaactgtataatgatcagaatatatggatattggcagagatgacatagcagagtaaagaacattccatccctgaaggtatttttaaagatagagcagttaaacattttccagtgggctgtaaggaaatcatgcactgggtaggcaaatggaccagaacaatactaagacacgtgtaatgtctaacatattaatgtccatagtccagggtgtccctgatgagaactcagtgttcaccactactatgaggtacatcatcgctgtaattttccaaagtataggagtgtctgggataaaacaaattgataactggaggattttttaagaaaatttttttcatctaattccagagctgatgtatactgtataagcaaactcaaggtttcttttggatgacaaaaaatttgcaggtgcaccaaagtgaagtatggtgcaattatatataaacacaccaaatattttcctttccagattgtctataaagatgggcttctctatgtctatgcatcaaatgaagagagccgaagtcagtggttgaaagcattacaaaaaggtaattcaaaaaaagaaatgttgaaagagaaaggtcaaaaaaagccataaaagagagtcgttttttgaggcttggtggaggaaagacatggcagtaaaaagactcaatgccaagagacaatctactgattttcctaccaacctcagggaatgtgtcagactcatcctcatttttgctttctcattgttacatacaggaagcctgtggattggattccctggcccacacaaagccagtattgtgccttcccagcagcttaggggaagccaggccacctgctctccactcagtatgcttgcctttaccaggggaaagtctaggtcatcatggggctatgtcaagtcctgtagctaccacacttttgatgtttatagaaagttacatctaatacttatactgagcatttaccatttgccagctactttatcaaatgcttgtaaaacatttttttaggtaaccctcttgacaactctattgaaaggggtaatattattctccatttttcagacaagtaaagtttttaaaacatggccactgtcatagatacagtaacgagggactcagaactcaattacctaaacctgattttttaaccaatacattgtaaatgctaggcaaaactgaagatttaatgaagcttttattcagtgatgtttaggccgccctggtaacaacttttggtagaagggagagaatcattgttaatgatttggcactatagtatttccctctgtgatattttcaagatgggtaaaggtgtgaagacaatatttaactcaaatgaatggctccatttgtgaaatttcaggtattatgctcctagatggaggaagattttattttattttattttattttacttaagttttaggttatggttctttcttagtacacctcaaattacacacagttactccactttgatgcaaatacacccttctcacacatagggcttaatttttcctttgcataaaaaggtttagcaacccattctgcgggtagcaagtggtccactgggggacagaagcttccctctacccaccaccagctcattgaaatgagaaagacaacccctctagagttagacacacctgcagcaaagtgctgctttgctgtgtcacctaataaaatcatctaccatctctgggtttaagttaatcctgacctgtcaaataggagatcacatttcttttctcctagagcagtcacgagccacagatgagacactcataaatatattaaaatatcttatgcacaaacatgagtcactgtggttactgtagggcttctaggaggagctctaagattctgcttcccatttagtctcctttggtggaatttcctgagcggtaggtgctatgtcctatgtacagctcttggtcatgccctgctagatctcatgtgtctgagcagctcatgtgaagacatacgaaatgtaaaggaagagcagagaaagaagcaaaaacacatctcctagcccctcataaaactgcagagagtccccatcactacagctgccatatgcacaataagtggtttgtctctatgcacagtaagtggtttgtatcagttagtgatgttttgggctgcaggtaaaaagacatcaaacagttgctgaaacaaatccacttttgttcttctctcacagtaacaaatgcaaagataggcagtcagtcaagggctagtgcagcaactcagtgaagtcagtagggatgcaggctcctcctagctttctgctctgttatccttagaagctgcaggagagattccaagccttcccagaagcctccctgcaaacttgtgcttatgtcacatcatccagaactatatctgatggccattgatgtgtacaaaggaggcaagaagacagtatcttttttttccagtctctgtgctggaagatagtgagaaagaaggtgcatgggatttgctgtcaagttggccaaccaacctgctgcaggaaaacaaagaggttctcctgctcaaatattctcccctacaaagtttcattgtgctataatggctcctcctgccttttgtgtctattatttggctcaagcattataaactgaggtagacatttaagatagaattttccagatgttaacctacacttggaaggtttgggctgattcagtggtagcataggagtgtgtgtcaattatcatggttctgaattcagctaaccagatgtggaaaaaatgtgctcttccttccaaaaattaaaacagaagggggttttgcagaggagttggcacctgtacatcataatgtagtagaaaaagcctgaggctgagtctcaggtctgctatttattaagcttgtgaagttgagcaattgtactacctctctgcacttcagtttacctaactctgtgagaggtgtaataacaatagctacccctcaggttcttgaattgattaaattagaggacatatgtaaaggaaaatacataaatgtaaagtcctatggatatatgaatatatgagttcctcttattgtcgttattaggtggtgagactgttgcaatgtagacttttggatttggttggaaaaagaattagttacccaggaaaccaaatccatgtagtaaggaaataataggaatcccaacatgtggaggccagaagcttagagagcaggaaggcaagtaatgtgcccaagagattgcaatggccatttggaaccaaaatcagaaacttacgttttataattttaactctttttgccttttgtgatttctgtcataatttccctttaattctcattagtaaagttttttaatgccagcattttcagctaaactgagctaagttaaattaagggaatgatatcactaaagcccactgtttattgaacacctacttactctgggccaaacactgctgggtgctttacatacattatctaacagcctcccaatgacccagcaaagtaattattatctccatacgcttccttgagtcaggactgtaaggataagcataactctcctgggatcaacataaggaaatctcaagatgaacataaggtcaagagagaaagagttaaaggcacatatagaaccagcccttctcacctagatactcttcttaaaatatactaagatcttgtaggtttctctgttgtatttcaaaagaggctaatttgttatagattacagtttcatttatttgaattatacattgccctattcccgtggctttttaaaatatgcacatattcctaggaaagtagccccataaaccattcattccttagtataaacatgtcaaagtcacagaagtcaaggaagggatgagaagcagttctaaattaagggaaactaagtgccatgtttgattttgaattggatccttgatcagaaaaaaagtgagtgattataaaggccattattggaataattagaaaaattttaaagatgaaatatattttaaataataaatgcagccataaaaaagaatgagttcatgtcctttgcagggacatggatgaagctggaagccatcattctcagcaaactaacacaggaacagaaaaccaatcaccgcatgttctcactgataagtgacagttgaacaatgagaacacatggacacagggaggggaacatcacacaccagggcctgttgggggatgaggggcaaggggtgggagagcattaggacagatacctaatgcatggggggcttaaaacctagatgatgggttgatgggtgcagcaaaccaccatggcacatgtatccctatgtaacaaacctgcacattctgcacatgtatcccagaacttaaagtaaaataaaaattaaaaaattttaaaaattaataataataataatattgtatcagtgttaaatttcctgagtttgataatcgtattacagttatataagggaacatccttgttaatataagctatgtgctgaagcatttatggatgacattatttaggtcataccatctactacttcctcataaattattaagcacaatataataatgattttaaaatttaaagaataatacatatgtacagagagaaagagatacagcagatgtggcaatcagttaataattggtgaatctaggtaaaaggcatatggatgctcattgtattaatcttattcttgcaacttttctgtacatttgaaaattttcacaataaaaagtagatggaagtgtatgtttattcaggccttttttttagaaccttttgctaaaatttagccccacccttccccttctgccacaagaaaacaccatgtgttgtaacccactcactttctttacagatatatctctaaaatcctaacatcaagctgatctgtatatgcattttactagttattttttcttcaaaaatgatatgtaattgtgttgttctcaacatactcatggttagacttttcttttttctttttggcttattaactgttgagtgaaagacctatatccttccggaaccatttgctcttaccttggttgctggccaaatggggtttttattgttctgtgataacagcacttactgaatgtttctcctcttggatcaacgtttgctaacgtcttgttttcttcctgtctgctcctcagagataaggggtaacccccacctgctggtcaagtaccatagtgggttcttcgtggacgggaagttcctgtgttgccagcagagctgtaaagcagccccaggatgtaccctctgggaagcatgtaatgtgtgattcctctgttggactggacgttgggtggatagtgctccattaggctaaacctgccagaggccagaagagcttgccagaaaacaagatgtgccagattggttggcatcatgaaaattcagccttgcagatgctatgtgacaaatgaaatctcattctagggtcaattgagtcatggccattaagataataacaatattaacatctgccattctttcatttcatgagaaacattttaaaaatttgaatcattaatcaagcaatgagctgttatttcctcccataatttttcttggttcaagataaactccaaaaaggtagaatatgttagatatgtcatcatagttcaaacagctaggtttccagtttggtaagaaaaccagctcgctcttcgtataaataacgaaaatcacaaactgaaaaaacaacattattaaaaaaaaaaaagatataacttaagtaacacttttcatcaccatgtatactaaaatgatggtcaaattttaaaatatatatttaaagcagttcgccattctctatatgtgtgttaatttcttaatgacatgagagaaggggctgctttacgtgaaatcagattctatccagagttgtactcccagggaaacaagagggacttatatgtatttaaagtttataattatttaacataaagttgttgataaatacaaaataggataacttattttggtaacagttttaccagcctggacaaaatatgcctggattacaatggctttaaagaattgaatgagatcagctacaaaatagaacttcatgaaatggaaaagatacaggcacataaaatattttttaaattcacttcatgacagtattgatacccaacaatcatgttaatgttaatactggtcattttacccccaaaaaatcaattaataaatattcattgtgttttccatcttaattagactatacagtgaatatttattaatctcaactagatcacattgctctatatactcatgaattatagttatttaatgaactatacagattggttgcacatgggtcttcgctccactgtaagggactgaggagtaatgtctccttatggtattaatcattttccccagtggttttgtctatggtctatttggtctattatcattacctagcaggtcagattccagctttgacaatgccctaactttctggaaggagcaggaaaaaggccagagagagcactgccttgggattgccttcctaggctctgtctggatgacactcaccatgtgttctgggtgccacaggtgctgtgcctctgaggaaaactacagagtgtagaggtgttgcagctcctgagcagctgtaatactgtctatctgtccaagtataatttattcccttggcttcttctgctgagctactgggaagtccatgggcataacaactaaaagagaaaaagttaggtgtctttatttctttttgtccaagatgccttgatccatcctctttccaggatacatggcctacataggagttgggccttatataggaaagctacagaatcactccagatgttgtgtctggattcacttaatctggagtattgctcacacaagctggttcattcttttaattcataacattgagtgtttctctttgttttgtttaaagttccttctgatattactttgttttaatgttcagatgctaatctgcatactgcagtcaatgaagagaaacacagagttcccaccttcccagacagagtggtaagtcaacattttaaaaatgtttttcatggtcaggatatattaaataaaccaagagttgccagattcaagactagaaaatgtggaattcatttagacttctcagcaaagagagaaaaaccatgagctctagataatagctatgggtggtattgaatagcggattcaaatatagaaccattgtaatatctcatatttttgcatttcattgttgtgtcttttcctagccagtaagcccataaatagtcaccaaaaaaaaaaaaagaaaaaatgggtgcatgcgggagatgtccttaagatggcatcacacataacaggcagctgttattagctgtcattctttccttaccatcaacatggccaagactgctttgtggaagtatcctggtgttgaaatgaaactctataggacaaaagcagaaaacaacataattctttccctccattatcccttcaaagctattcagtgggctttcttccctgcttccaaataaagtctttgccaaattccatagttttgcagtcattctcaaatgataaaaatgtccccattacttgtaatcataagaacagcctctgaattgttccatccaatgttattatcacatgactgcaaacatcattccaagttaaacatctgtcacctagcttgggcctgcatcacctggcagcatgcttttggggagggattttgggggggctgagattcatggccctttcagagttagttccaaggaagatgaggtctaattaaaaaaagacacacatagctgtttctatcatgatttggtggtggtggtatcggagtgagttttccagcactgattctttatctcatgggagacttttaggaatttcctactgaagggcagatccatatgtagttttatgacaggggagagatcttgatcctcagttcttggattttcagccctcaatctttcaagatggctgtcagccaactttttcccaagagtggagttggcctataagaaaacaaacaaaaccttgattgctctggttaattaagctgtatgtagctctctctcgaagtacaggctactgctgtctttttgctctactctcttgggttcatagccacagccttctgtttttagggttcccaggcaggtgtgagcctcctcaaatgccaggatacacaaaaaatggcttcccattggttctctggaagttcacctgaaagcaaggggacatctccgcccatctattggatctatggtgtcttgggtacttattttcagctacacacattcgcacacacttctctctttctaagtaaaagccacataattttcatgaatcaacatgaaagacaaaaataatccattattgtagtagactgaataatgtcccccaaatttcatatccatgtagaacctcagaatgtgaccttattggaactaggatctttgcagatgtaattagttaaagatcaagatgaaatcacacgaaagatgagagtgggccataaatccaatgactagtaagatgagaggacacagagagatacacagaggagaaggccatgtgaagacctaggaagagattggagttatgttaccacaggccaaggaacacctgtttcttagtccatttgtgctctactaaggaatacctgaggctgggtaattgataaagaaaagaggtttatttagctcaccgttctgcaggctgtacaagtagcatagcactggcatcggcatctgatgagggccttaggctgcttccactcatggcagaagggaaggggagctagtgtgtgcagaaattgtatggtgagagagaagaaacaagagagagggaagggagatagcaggctcttttcaacaaccagctctcatgggaaatcatagagtgagaactcattcactaccatgagaatggcactaggccattaatgagggattcgcccctatgacccaaatacctcccattaagctctacctccaacactggagatcacacatcaacataaaatttggaggggtcgaatatccaaaccatagcaacttggaaccaccagaagctggaagaggcaaggaaagattttatcctagaggcttcagaataagtatggcaatgctgaaatgttgattttgacttctagcctctagaactgtgaaacaataaatttttgtggttctaatccaccaaacttgtagcaatttgtcatggtagccctaggaaacaattataatcgttaggagttttactttgttattagcaacattgctgtttgggtttgaaaatatgtttcagtcctgaagcttgaaaagtatggccctctaaaacacctaggagaaacgcccagattaggcaaatctatagaaacaaagggtgatcagtggttgcctgggaccagagtagggatgagaattgactgcaaataggtatgaaggatcttattggagtgatgggaagactgggctgtggtgatagttatacaagttgataaatttacaaaagtcactgaattctgcactttaaaaaggatgaactaccaataaagtttgttttgacaagtctaagagcagaagataattaagagccagaaaccattgcatctagtctccagcagggaactttttggccaatatattgaaaattatcagctaggcaaatcagtggctaagggttcataagcctgttttgattataagcttcccaaatgaaccagggatcagagggtatcatgtaaagtatgtttttctttgttttgttttttatcagagtattcagtagagggcttattttctgaatggaggaaataaaaatcagctctctagttgttctgttcaaagagatttccttaaatgatttccatttaaggaacttcctagtgcatttttctttggacataacccacttcacagctcataaataacactgtcctgcataattaaaatttccagaatgtcaaagccttaactccaagtaaatgaaatttctgaaaaactaaaatatagcatgaaaaaaatattaaatgcatctctttctgtcacacacgcacacacagacacacacacacatattgtgaatttttaactgaaatataacattaacatagaaaagcacacaaatcctaagtgttcagcttgatgaattttcacaaactgaacaattctgtataatccaccctcagataaagaaacacaacatcacagaaccccagggacaccctgatgttccctttcagtcactactaccctccaaaagtagttgctaacctgatttataacatcatagattgtttgcctgattttgacttttatatgactggaattataaagtgtgtagtcatttattgtgtgtcttcttttcttcaatttgtgagattcgcttatttttttagtatgtgattatatttaccgtcatcattgtatagaattcagttgtgtgaatatacaactgttttggtttcttattactgttctaacaaattactacacaaatttagtggcttaaagcaacatacatttattctcttatagtttggaagatcatatgtctaaaatgggtctgcacagctgtgtttcctctggaagctttagggaagattctgtttccttgcattttccagttcctaaggggtacttacatttattggttcctggctccttcccctgtctgcagaaccagaaggttgcaggacctctactctctaacctctgcttccatcctcacagctctctaatctctgaccaccttatctcccttttataaaggccattttgattacatcaggcccacccccacaaaatccagaatagttgccccatctcgaaatccttaattacaatctgcaaagtctcttttaccacgtaaggtattcacaggttctgggaattaggacatgaacatattcgggagaccatttttcagccttcaacaaccacaacatgtttattattttatcctcttgatgggcatgtaggcagtttctagtttttatctaattaaaataattctgctatgaacattcttttacaggtcttttggtttccctgttgtgtatatatacgtaaaatttatgagtcatagggtatgaccagatgcacatccagatttactagattctgcaaacaaatttccaatgttgttgtaccacttcatactccaaccagcaaaatatgagttccagttgctccatatccttgctcatacctttcttctttccttgcctctttccttcctcccttcctccctcccttcctccctcccttctctccttcctttctctctctttcaagagctgatatacttaattgtcagttcccggtacctgaatctgtgcctcactgtgatgtattaaaatttcttcccctccaaagctgaagatacctcgggcagttcctgttctcaaaatggatgcaccatcttcaagtaccactctagcccaatatgacaacgaatcaaagaaaaactatggctcccagccaccatcttcaagtaccagtctagcgcaatatgacagcaactcaaagaaaatctatggctcccagccaaacttcaacatgcagtatattccaagggaagacttccctgactggtggcaagtaagaaaactgaaaaggtaatccccagctttcagacgggctgcccagcatgtagagtaaacactaccccggctgccctggacctcagcctcaaagctgttgatccaggtcttaggctgtcctctcagaaaatgttcagtgcttgagccagaagtctggggaagcagtggccccactggggctgagaagcatagattttccatttagattatccaatctaatgatctcagtaatgcctgatcattgtattcccttccctttctcctccttctccccccaaatatctccacattccagaatacagaatctttaaaaatctatcctttatatgaaagagcttaggatgggcttacttttgtaatgtgcttcagtatcactagccaaatggcaaatagcatttcaagcaaggccatggcttgccttcttggaatgtacaacctcacctctcctgacctgattagtcttctcacagtttttagcctaaagattctatctaaagccagaattgaaaattccttgaaggcaacatgtaaattgtgtatgtatgtatctcttggtatggcactgaatttgccctacacttgatgcccaataaatgttgaattgaattgcaagatgaccatatggaaagggtcaagtgactccccttccttatttcctgtctcagacctccttcctatcatgttgtctactctctgccatcttctcactcagttatcagcatccctgcagggaagtcatgtctgcctttccccacaatggatacagagcatctctctgactcaccatgtatctcttttcttagttatttttcccatgtccttttattcctttgttctttccatcttcatcatttttgcctaaagccaattactgaaagtttcaataatacagggccatatggaatttgaaataatgtaagtgtgttcttcttgattttttttcagtataataagccatggtccctttcattccaaagtggagctagaatcctagtgtattaatctatacctggtgcccaaggtatggggttacatttgtgcgcctgcagcccaccattcttgtggaaggagaggatcagtaaacccagttgcaaggagagtgaaagtcatgttaattgtgttccaggtccccttcctgacagaaactccagtgattcattgagagaggtgtgaggtgaagctgactgccctgttttcaaataaccaggaggaactgtcgattcacatggggttgctgccattattgagtttttgacactcctttagatttgcacctccttaggtttagtcccaactgtggattttccctagaacttcaggaagctagttattttaacaaaggattgattgatcacctcttagcatgagcagcattgcatctgcaagtaaattataataattgctaaaaggtcttcatggagcttgactttttaaagtgcagccatgattcttatctcatatatgggataatactttttatcaactttctgtcattcttacaatcttccctgagcttctttttaatctactttctgtttagtaagataatctatgcccccattaaatcattcaaatattacagaatattccatttacattcccctaaaatgttttctatgcacatgtggccatgtgcatacaaaagcaagtaagttctcacgatacagtctttgtcatttgttcttttcacttgacatcttcagcatttttcctatttgaatacatgaggatacacctgacttttaaaatttcattttcatttaattttggtgaaatatacataacataaagtttaccatcttaattatttttgagcatacagttcagtagtgttaagtacatttacattgttgtgcaaattgcctgattatttttaatgtctgtaagtaccagttgtatagatactaggtaaacctaagtgatgcactattgatggacattctctaagtgtttttagaaacaacaaggctaaataaaagctattctagtgggcaaggctctttgggaaggtggagagagaggcattttagagtttaagggctttatctaggcattccttgaaatagagccaggggagcatttccttgctaaggaaacttgtttctatgaactgtggttttgaaaaaagtctggactatgaaggcaaacaggaaataggttccacattccagataaaacagcctttagactttgagaggtaggcacttcttcatgctctgcttaataccccaaataaaagagataaaatgatctatggcagaggatgatgaaaatcctccttatccatctgtgtccagaaggagtaaaaagatcagcattttcaagaattttaattgtagtcacaatagctaagaggaaaataagttattttaaaatatataagtgacagaatgcttgcatatatataagaaaatcagggcaaatccagtcaagatgatttattaatctagattttccattgtttaagataattatgagccattattaacaattttcttttgtttagaagtgttgccagactactgcttttattggaatgcctgaaagaaccaaaatgtgaaagtaactcattagcttaaatttcccaaacaagtgaaatgtgtgggtcaaaatgtcaaataaagctaaaacatatctgaacaaaattacttttgtcatttaaaatttataagtagacatatgtttataaacttataaaatgtctcttttttgcagtagcagcagcagtgaagatgttgcaagcagtaaccaaaaagaaagaaatgtgaatcacaccacctcaaagatttcatggtaaatcaaattcagatatctcctacatccagaatatgcttccattttcaggaaaactaaccaaacttgcaataattttgcagctaggctttctacttaaggtaaatataaaccaaaaaagtctatgtagtttgcctctctgaaccctgaatggatggcttttgggttctagtttttcttgaactgactattcctagccagcatccatgacatacaccagtagtagcaccaacattagtatacctgacccaggcatctctagcaggaagaaaagcaacctagagttgaataactcttccataagaatagctatatacacaacccaatttttttttaacttgatactacagccatctctgaaggagtcttcatctatttcgtgagcccactctttggaaaaagtcaaagaaatataagttcttctgggggcctcctggggatctcctgtatcaaagaaccattctttcattaaaacttggcataagcccaacttttgagtgactctctctttactgttgctgtgttgatactttgccaggtgcagaaggagaaacctaacaatctaaatgttatttaggtggataaaatcagggtgggatttgatattgcatggctacgcacttggattatttcttggtgcttttctgcactcacgtttttctcaactcttcttaagggaattccctgagtcaagttcatctgaagaagaggaaaacctggatgattatgagtgagtattgaaagtcttctgggttcttctaaaattagacatagatacttctactctcttcctcaaagacattaaaacagatggctgagaccgtctcaggaggctgtatttacatgggtaaactcacgtaatgttctgggtcatttatctagatgacaggtgacaatgagctgggttgttaccaacgaaaatattttccccaaaactggattatctaaattggatgcaaatacttattggatttatcgtatgtccagcgtcaccttcatttcactttacctttgtagatgtagcatataatgtttctgctcattatttctttcctggagacctctaattaaggtgatgtttgaaagctcttattaacattgagtaatatttttggagaagttattaatgatgcagtaattttacagggtagcacaaatgagaccttgaacatggcaatatttatgtcgacagatctctattcttaggatgaccttgtcattttttttttttttttttgagacagagttttgctcttgttgcccaggctggagtgcagtggcatgatctcggctcattgcaacctccacctcctaggttcaagcaattctcctacctcagcctcccgagtagctaagattacaggcgcctgccaccatgcccagctaatttttgtatttttagtagagacagggtttcgccatgtttgccaggctggtcttgaactcctgacctcaggtgatccacccgcctcggcctcccaaagtgctgggattacaggcgtgagccacctcacccagccaaccttttcatttaacatcaaaattgggatactttagaaagagaaaaagtgcactattaaaaattatacccgttaataataacttaattatacattttaaaataacttaaagagtataattaattgtttgtaactcaaaggataaatgcttgaagggatggataccccataatccatgatgtgattattatgcattgcatgtctgtatcaaaatatttcatgtaccccataaatatatatacctgctatggtgagccgagatggcgccactgcactccagcctgggcgacagagcaagactctgtctcaaaaaaaaaaaaaaaaaaaaaaaacaacacaaacacacacacacacacacacaaatatatatatatatatatatatatatatatatatatacacacacacacacacacatatatatatacctgctatgtactcacaaaaattaaaataaaaattacacctggacatttgacataaactggacttctgggcaaataagaacgtgtggtcaccccaactatactgagaaggttggcctaagtggctattaaggttctttccaaaatctaagggtctatcattctacaaatagggacaaataattgtctcctagatgtaaagattagtgttaagaagaggtgggaataatagagcatattgcatttctcagacacttgataccaaatggcacagaattcacttgaacactaggattatgcatatttccagttctgtttttgtacaagtgttgtattattgatttattgattacatgtgaaacgagagcttttacaaagtacatgctactgttttcactcctcctctcatctctaacccagcctggtcctagccatacctgttgcattggggaagatgtgctgtaccctccacatctttgtggcatggtctctttatcaccttctagctctctttcggctttactttcttccctaacatctattctcaggaaagcattgatggaataattcatactaagacataaaagactgagaatgaccaacgcatggtcatttccaaagataattgcactttaatgaaacacaaagacttaaaccaatgggagtgaacctctaattgtggattgtactctttagcatttaaataaattagaagtctttccctgattgggtaagcccagatatgaccatttaaacagtctctattcccatcttttctgaatgcaagtggtgtgtgagagacagacattgaggaaattatcagggaagacttgtcctcttcaaaatcaaaaagataccaaaaggagctcgggattatagggctataggatctgggactcagtcacctcacattgtgcttaatgctcccagcttcctattctatcagtgtcatgggagtttttgttttatggccataacttcatgagcaattccagtcaattccattaaagacagaagcactaagccctgagatttagatagaaaatcgtgtgttaagactaggcctggccaggtacagtggcacatgcctataatcccagcactttcagaggctgagctaggcagatctcttgagctcagaagtttgagaccagccggggcaacatgacaaaacctcatctctacaaaaatacaaaaattagccaggtgtggttgcccattcctgtagtcccaactacttgggaggctgaggtgggaggatcacttgagcccgggaggtcgaggctgtagtgagccgagatcataccactgcactccagcctatgtgacagagtgagaccctgtcaaaaaacaaaacaaacaaaaaaaaaccttaggcctaggactctgctgctctgtcattgaatactgaaatattatttaaaacaataagaggcaggcctcagcaaaattatgacacaggcaacgtttgtatgtgtgtgggaggtataatgtatagggtacataggttatatcaccttgcctctccaggcctctctcctgattcttgattttcttccttctattcccctgtaggtatatatcctgtatcacagcccctgaagggccttttgattagctagtattaccttaaaatgttgactaataagaaaaacgatcagttaaaatttcaagtgttagttatacagtatccataatggtagagttaaaagagactttcaaacttatcaagatcaaccctctccctagttttacaggtagggaagtccaaggtcaaacaaggccaagtggcttgttcaaagtcatacaattacacatagggaagttatgcctagaacccagacctccaagctgggtgacctaaggctctttctattttattgagctgtccaccagctgacatcccttcccaaaactcatacagagattatacaaagaatcacttcccatccattcctgccaagttctgagataccttctacattgaatttctcctataactcctcccttctaccctcacccccctcttgtacttatttcctctgcagatgttatcttctagccagtgggtcctcccactcacccaaacccatgctacatcccacctcatgccctgcttttactcatttcctaagtaggacattctgtctaaagcccaaaggccacagacattattgccctcacatgagaaacagctcttggcctgttgagctccacatataaagtaaaagcatttgatgtgaaaatagatgttataatcagattattacaaggaaattatatgattggaagacaagagctttcatccttggcagccctgactttcctcttggaatattcttcataggtctaatctctagcccttactcaaaatggtaaaatgtaggaaaacttagaagtcacctagaagaaaaccaaagattcctaaatgccagcccatttaaaaattagatgtgcagactccaccccaacatcagaatttagtagtggggacttaagcatttgtatttctgaaaagctcctcaaatcattctctggagcagttaggcttggaaacccctgaggtaagccaatgcctcattttacagattagaaagttgagtgtcaagctatacaatctaaaacttattgattctcacatataatttttttccttttgcagctggtttgctggtaacatctccagatcacaatctgaacagttactcagacaaaaggtaaatagtcttgtctttaaaacagcctcacagaatctctttgcattttggggtccagaggttgatgcatttctcatagaaaccttcctgctaattatatagtcaagtcattgtagtgttgcttgtccagtctgtgggttgcccgactcttcatgtctagccactacttctgtgtccattatgtattgctgcataataaaccactcctaaattgggtggcttgaaacagtgggatttatgatatctcatgattctgtgagtcagctgggccagcagttcttaggcaagttttgcttaggggcactcctgtggctgcatttgggtcgtggattgactgggggcttgggtttagctgaggcagtcaactggagttccacagttcttccccaagcagtctctccatgtgcctcacttgggcctcctcacagcatggtgatctcaaggcagtagttgaagaggacgagccccacagtgcaagcacttttcgagtctctgcttttgttgtgtttgctaaggtcctattggtcatagcaagtcacatggctcagcccagagtcagtatgggaggggactgctcacagcatgaataagagagatgatttatcggaggccgtcaatgtagccattaacctcagctctgtcactgctcgttagcacctagaccagagtatagcagatgtgatacagaacatgtttatctgactttattactaattgatatggaatgccagtagcaaactcttttgatttctaaaaatgacactttgatatagtttaacctgataaaaacactaaacattacacttatttctttgaggggtgctagtgagaatgtaatgacttcatttggcgttttgtcacattcatagtttataatctgctctttctgaactttgatctgcttagaattagcacaaatcattgagaaagacaacttgagtatagaactttatcaactgatttattcttgatctttggttttctaaaaccttccaaaggcatgatacggtgatacacggttctaaattgtatttcttaaagatgaaaacattaggcttgcataagcacaacaccgagaaaagtaagtgatagggttaaatattaattggagaggaagagttcatacacatacacatacacatagagcagatctataaagagattgagtgagaaacctgtgccttttgtgatatataaagtcaatctaaaagatttgttttccaactacctaccatgcaaaatcattttcaagaatgatgaaaatattttctattccttctatattttccttccttttcagggaaaagaaggagcatttatggttagaaattcgagccaagtgggaatgtacacagtgtccttatttagtaaggctgtgaagtaagtatgatacggattaatttcttttctctttctgcgtatattctttgaatatgctggtcacaatcacattttgggataagacatcatctttaaactctggaattttaaatcaaagtatttctattgaatgtgaccatttgtagttgcctccaccactctcaccccactgccccaccatccttgccccactactttcaagaggccattctctggctaatcctctcctgccccactccaggcagtaacagagtgcccagagcacagcatgcctcagtaaatgtttattaagagactctcgggtgattccctttcattcaggtctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaaaagttcttgtttgaagccaaacttctagatccaaatcctggctctactatttcaatagggctttgtgacattgagcaagtttctcagcctctgtgcctcaacttcttcatttgaaaggggaacataatgattgttacgttctatgagtggggtgagttaattaatatattatatccagaacagtgcctgacacatagtaagcacttaataaactaatagtacttactattattgttgttgttgttgctggggaagggtagttctacctgctccactccctgtaccctaacacttgggcataaaagacaccccacagtcatctcatgcaaatcatcatcaaaatccttctccagagttttacaagccactttcttattggtagttagctctttttttttccttctaatcgtcctccaaagcaaatgggaaagctgtttttatttataccatattgcagatgagaggattgaggttcaaaaagagcttataaagacctacctggagctactaagtgactaatttgaagctgggcttccaatagccaagtcatgtttctttatctacacctctgtgtttacactgaacccccagtgttttggaatgagaatctggtcaaatattgattcggatcttcttttaaatttctatgtgtgcaactcttttttagcagctagattgaatgatcgtctgccttggtgccttccccatgtgccctaccccacagtgcatatatgtatatttataataattaagtaataaaaacgttattttattttgaaattttttacagagtgcctacctacacttgagataataggatgtacctgaattgtcccacagcactttccaatgccagaatccatgtccccagtgtatctcatatattattttgcacatggtaacacctggatgctggctaaagccaacccagtaagaatcaggagaagactttgttgactatcaaaagttttgtggccttctggccctgcagtttcagccaaacctggtatcagatgtccttgtagttgagtttcttgactacagattcattttttaaggtagccaggtagataaatcagcaaatagataaagaatcaaatgaatacagaagccctcttttatgaaacctcatcaatggccttgagtgaattgtatgctgacaccaaaagctgattaaacatttgcagcaaagagaagaaccatttctccttttgtacttgcaatttttactcggttgatgttacagcaacaattttttaattttttagcttttattttaagttgattggtacatgtgacaggtttgttatataggtaaactcttgtcatgtggctttcttgtagagattatttcatcacccaactactaagcctagtgttcaatagttattttttctgctcttctccctcctcccaccctccaccctcaagtaagcctcagtgtctactattttcctctatgtgtccatgtgttgtcatcatttatctcccacttacaagtaaaaatatgtggtatctggttttctgttcctgtgttagtttgctatacagcaacaatttattaactgtttcttatatgccaggcataaccatataggtagctagcaagtgatagaactaaactcaaagcctggttcttgaccactatgtcattgtctacaatctaagacaggtgtattattcctgattagcttaaatcaacgtgcatcaattcagcattattgtataaaagcagaggaaaagaaaaaagtgttttatgtggagaaggtacaagttcacatgaggaattaaaggacatcctcacctacttcattctgcatgccccaaaagagcctcctcccatgttttggggtgaggatacccaacagcctaatcacctttacctctctcatttccacctccattattatcctataagataatttatgttcagaataatgatcctgaagaactacaagcctctctcgatcatcaaagaaagattccagttttatacacttactaagggaggagaagcctggaaagttggaattttactgtacatgaaatctatatgtgcaccaaaagatacattgagttcagagaagaactctcttccataattacttttatagttacaccagatttcaagactgagaaaaacaccagatgccaagcctgagaaaacctccctgacttccctctccaaaatttgcaaatgcacctaaaataattatttaacccttgcttaatcaagctttattgtttattttaaatgttctaacattctttctgttactagtgataaaaaaggaactgtcaaacattaccacgtgcatacaaatgctgagaacaaattatacctggcagaaaactactgttttgattccattccaaagcttattcattatcatcaacacaattcagcaggtaacttattttagtttttcttttatgggcccttgttgtaaaacagcaattttcctggatactactgatcctcctaatattcttaattatatagggaaccatgaaagtaggaaaaaatcctctcaagtcttttgcctatcataatttttagcttacattcccaggaatataacatgattctctccttaatgccagaaagaatgaaattgagtaaactgggtgacttagaaagagaaattctctttataaaaatattcgtagggtttttctgtgtatagaagcaagaggattataaatttaaaatattatagaaatatatacatatcgttggatcatggaccagttgtctattatgacagggttttttgcatgctgccactagcacttactaatcattacatatataaatagaaattatatattatgtatatacattacatttttacagagatgagatcattctacacatattgctcagcttgctttctttactcaacatgtcttagaagtctttccacgcaaacacaaagagcttactttggtctatttaacagctgtgtagaattctatcatagttaccccataatttattcacctagccctctgttgattagcagttggatcatgtccagtattttcacattataatggatgtttcagtgcacaattctgcatgcatagctctgtccatctatatgaggggttctatagccaaatccctagaaatggaatttctgagacaaaggctaagaatacttaaaatgtacagattgccaactgcttttcagaaatgtacaatcctactaacaacattttctttcatcctcaccaacactgggtgctattagtcttctaaatttttgcctaatcaactggtggaaatacatctagaaataccctctgttttctagaatagtgccacttaagagcagtggctggatgaatttccaacagtgagtaaaaataagccataagctcagcacttaatttgtgttactttatatgacttgattgcatgcatgtaggtgaattgacctcacttctggctttcattttggctcttactgatgtttttcctttgccccaatttcctcaattgtttattttaacctgtagtacctcagaagtaccttttgtaaaaggtattgcacaaagagatgcacaggaaacttcacaggatatcagaaggaaatattaagatgtttatttatatttggatttttatctcattctcttacattttctgtttgtgagtttatttttataattcacaccaaatatatattttatagaaatgtactaatttttacattttaattaattaatttagttgattaaaggtaaaggattttaaaagtttggagaccactcatataaaaaccagacaaatatatagaaaaaggaaggaggggaaaagtacatgtgtgatagataggtcccttgacttggagagcattccacatttaaagcaaaaaacatatatacatatattttaatgggttctttcaagccactattaaattttataattactttaacccagttttaccataactaaatataaacaattaaaatggcttgaccacttaatgaaacttagtaataggttcagtttttaaaaattcagatggcttattatttttacccttctgtattgtttgaattttttgtcaaatgtatgtgctgtgtgtatacatattttaagcataagattgtaaagagatagcaaaaaagaagggggagaattttaaaagattacatcatgcaattaatttctatgggatttttaaaaatcacatacagtgttttattcatttaattttcgctttgcattaagctaattagtcaagttaagcacaactacaactgaatggattctctctctgcattacaacattctgaactctttgctttttcagccactttggagagagactagttgtgaaccaatgttacataatgtgatgggatatgatataatgatgtgatgatatgatgctgattccattgcaggcatgatcacacggctccgccaccctgtgtcaacaaaggccaacaaggtccccgactctgtgtccctgggaaatggtatggatacatacttgggttcttaaactccattttccatcattttttatttaaatatatggttaatttactggcaaaaaaaaaaaaaaaggaggaaagacaggaaggaggcctctgttcagattgtatcaggaaggattttctttaaaaaaaaaaaaaatctgtcctctcaacctaaatctgtaagcttctagaatcaccaagaagatcatcaatttgttttcttatcagaccccattattagcctccagcacaccattgtctgtcctatctttttcctggattttgtgcccactgagcagagccagtattcaaccttgtgtgttaggacgatcacatccactgcgatcacagtttaatttttttattaaaaaaatctgacaatgttttaccaatctaaggacatcgagtacattttgatgctaagcctctccaagatgcctctgattggcaaattgtttttactctgagccttcttgttaaataactgtagctacttcaagaatagtgttaccctggtgccattatcacgtagccacaagaccacatcactaagggtttttttttttaacttatcaacttaaaataaaaagtcttgtttatattgtcactgtgaaactcccattggagaagaaatcacttgggaagctgttagccccaaagctttctatgctcgtcctaaagaatgtccgtcttgccttgttaggaatctgggaactgaaaagagaagagattaccttgttgaaggagctgggaagtggccagtttggagtggtccagctgggcaagtggaaggggcagtatgatgttgctgttaagatgatcaaggagggctccatgtcagaagatgaattctttcaggaggcccagactatgatgtaagtttttcccaaggaatggctgtttagccctcatcatgggagggcattagcactaataggcctgctgttaactttgcaaggcctagagcaaaagtccacatactgtatcatagacataaatatttagaagttataaattgaactaacagactattaaatcaaatcagtcttatgctcctactttgacaaatataccttcataacaacctgaaaggccatattcaaattgagaattcccaagactctacaaagaaaccagcctctggcctgtggtcttccaaactccacccctcctgcttctcccctcatacccaactccgtcctgcactataaggggcctcagtagttatgtacagacacagcattcagtacacacaagctccctctttgtctcccgcaaacaattatctagtggctaatgatcttggctaggggtagtgtgctttacccttaagcggacagactccttaaggaagagtcagcacaggtcctgaaagaggcctcaggactatatggttgggtgatttcagagtcctggtgctctaagggtggcagagaaagggacatatagggtcggagtaggcatgtctccttggccctgtggcctccttgccctgtggggaggtgcatggtgggatgaagaacagagtggggctaccacccagaactaatgcagtactgaaaattaatgctctaccaacaatatccttttccttcttggtaccttcaatacagtctaatactcttcctaatgtgtctcagctcccagcacaacagccttcaattattggcaatacatatgtgttctctttccctctgtgtcttctctctctctctctcttccccctctctctctttctctctccctctctctccctcttcctctctctccttctctctctctctccctctctctccctctctcagttgtatataattctccctcttcttgtcaacatagtaaatcagactttgtagagtgaccaccattcaggtttgctgaggtctgggaggttttagcactgaaagtcctgtgtcctaggaaacctcccagccccaggcaaaccaggacagttggtcactctacttttagagaatcaatcagtatggtatgaaaaatgatgttatagtaggtctctggtcaaaaatagttgaaataaaaaaattcctagcctgctagagattgagagcactttttaaatttttacttaaacagttatactgtacagtgtttacaggcatttctctaagcactttacaaatattaactcacttaatccccataagaaacctatgagggttgtaccatcgttatcttagatttacaggaaaccgaagcacagaaatgttgaataacttgtccagagtcggcaagctagtaaaagtcgaaaagcagagatacaaacccaggcagacattctagggtccatttctttagttattcttttatgaagaccaaaggaattaggaaagtcagaacaatcacttttaccataattgcaaaattatttggaagcagagatgctatgtgaatataggcctttggccctagctggcttcatgggcatatgagatctgcacagttgcaagggcctagaagtacctagtacctagaaggtacctagaagggcacagtacctagaagggccctgtgcttggtttaatgctctgctgttgtcatcttgaagtaatacttcgtgatttttaaacaaggattcctgcattttcattttgcattggtgcctgcaattatgtaactggttctgccttcagtgattggactgtcataaaactgggaagggggcccctgatattctcctcttgtaggacaggaaaatctggcagaaactttctgccagatttttctcatggttacaggctcatgatgtaacctctgtgtcttggtgtaactttaaaacatatttttgccattaccaagctggtatccataaaaaaatcacaagaagtcatttaaaaacatcacctaatcataaagaaaaacgtcaaactgtgccacaatgggaaaaagtctaatcccaaatgtaggggtcaagctgaagcctatcatgtggggaatatcagttaatatggcgccctcaccttgagccacctgggcagtgactgaatttgttcaaagaatatttctttattgggtgatggacctttgtgccatcacaagccttccctctgaagggagcagtgttgagtaccatgcaggtctccaaaactgctaaaagatgaatactcccaagctcatcaacttgagtgacatgataagcattgtccctatagttaaactaagaaggaagaaaataactaaaaatttaataaattcttattaaaatatttaaaacttcacatgttaaatttagatttctttacacatttgaacattacagaataatcctgtaaattgttaaaattagattaatcatataagaacaagttaatgagcttgtaaaaactgagtgtcccttctcaaaagaagacatttatgcggacaacaaacatatgaaaaaaagctcatcatcacttgtcattagagaaatgcaaatcaaaacgacagtgagataccatttcacgccatttagaatggcaatcattaaaaagccaggaaacaacagatgctggagaggatgtggagagaaataggaacgcttttacactgttggtgggagtgtaaattatttcaaccactgtggaagacagtgtggtgattcctcaaggatctagaaccagaaatatcatttgacccagcaatcccagtactgggtatatattcaaaggattataaatcattctactataaagacacatgcacacatatgtgtattgcagcactattcacaatagcaaagacttggaaccaactcaaatgcccatcaatgttagactggataaagaaaatgtggcacatatacaccatggaatactatgcagccataaaaaagaatgagttcatgtcctttgcaaggacatggatgaagctggaaaccatcattctcagcaaactaacacaggaacagaaaaccgaacaccgcatgttctcactcataagtggaagttgaacaatgagaacacatggacacagggaggggaacatcacacactggggcttgttggggggtgggggataggggaaagatagcattaggagaaatacctaatgaagatgacgggtgcagcaaaccaccatggcacatgtatatatatgtaacaaacctgcacgttctgcacatgtatcccagaactcaaagtataataaaaaaaaaaataaaatttaaaaatcaacttctgcgtggcaacaaaacaaaataaaaaccctatgcaaactaaaagacaaatgataaactgagcaaaattatttgtaattcatattatggacaaaagactaatctccccaaaaaggctaatacctccaaactcattaacaactacactactgcactgtttgtttgtacaatggatcactcagagtcagctcagaatctaagagtaaagtacatgtcaatccaaaaatgtgtccaaattcactgaaatacaatgtagaacagaaaagaaagagtaattggagttgctaagtactttcaaaaggctttatgcttaaccgtgaagacagtaaagagagtaaagcagcagttcgggagcctgtctggagaagtaaaggtgatatggcagcacactgctagagactccgctagacatttagcttaacctatgcatctcacaaatggaaaaaaaaaaaaaaagataggtgagaaaagatatcatgagaaaggtaattaaggtagaagaatcacactttacaagaaggtttgcttgatttcttttaagctctaggctagtacaaaatttaagattgatattacttaaattaataagaaacactaaaggactcttcaattcgcaagattaaacacttccatctggaacatctgattactaaataatagcccatagctacattacgctccattttcttctacttaactttatcattttaaaaagggtgctgggaagaggtacggtaaaaccatctgccataataaaatgaaaattatctcattaaaaaaaaatctgagtgtccatgccatcatgacctaccagaagtgctacatcatatggttagtattttataaatttgttattcaaaaataatgaaaacaataatgtaaaataattttttaaaaaagaaaaaaaatcaaacctcatctgacttcatttagcctacattcttcgtattctaatatacttttttagaatgaaatatttagatgtgaaagttaataaaagagaaatgattgttcttagggtgtggcttcctctaaataagtcatggacgttcccaggatgccatgagactcaacagggtttccagtgcaacagaccattgctaccctgattctctgtaggaaagttgaatacagcattcacaaactgctaaattgctgctgaagtcaccaatgtctgatatgaggcagaaattttttttgcctccaaagataattgtgcttgaaatataagatcctaaacttttccctctctttctctgttcaagtgaaagagggtgggggtgggaattaaaacaaacagaaatctgagagcaactctttttcagtacatgtagaaaatggagtgtggagcattgaactttgaaaatctgttatttccaggaaactcagccatcccaagctggttaaattctatggagtgtgttcaaaggaataccccatatacatagtgactgaatatataagcaatggctgcttgctgaattacctgaggagtcacggaaaaggacttgaaccttcccagctcttagaaatgtgctacgatgtctgtgaaggcatggccttcttggagagtcaccaattcatacaccgggacttggtaagcaaagccattggaatttcaaagaaaagaaagcagtccacggctcccacttctggagatggggtcactggtagggaaggcaagaagggcaccatcacttctactttgctcacttgtgacttgtttaagcaaatgacatttttacaaaaatcaatgtaaaaatatttgaagtatggaaagaacagtgagaataaaataagctgttaaggtctacatagctgtgttgtggcaagaaggagaacagatggaaaggaaagacttctgccaatttagtgtctctcaaaaccattaaacccaaattgaccttcatttcaggaagggcttagtgctaaagcagccatttgatacaataactgaacatgaaaaaaaaaaaaggaaatagaatttgtgtgtctttggatcagaatgagagtggggaatgctgtgtttggtattcactgggatttatctttagagattttcttgcgctcaacagtagacctgcattcacactaggccagtgtgttccctaagtcacaggtgcagcgtttatgccttcaaagcatctgtgaatgcacggtatctggtggtggaaagggagattctagaaatttctcatctttccttgataagctaaggttctgtgtttaaagtgtaataccttttcatgttgtttgacaaggatggatgcttggttgaaagtactcatgggagaacatttttattttgaaaaattgaaaattgcaaaggaaaaaaaagacaactttagagcacttgggggttgtgctaggtaatcttagattttgctgagaattctactcaaaaggaggaaaatgtcaggagattcttggtcactttcactacttggtgattttgtttttcctttaaaggctgctcgtaactgcttggtggacagagatctctgtgtgaaagtatctgactttggaatgacaaggtaagccaattccgaaagggcaaccagtgaaagggggatttccattcacatttgaacaccatcataattgaaggctttgtggggatatagaaggtgctctgaattgggggcttagaaacctaagtccctcccatgggattgttcttcagaaattatctgacgtcacttttagttctttcaacaatctgatactttctaaacttctaaataaattccatgaaagatcctaaatttaaatacaacatgttacagccacattattggattgttttactttcttttaaatttttttatttttaatttttgtgggtacatagtaggtatacatatttatggggtacatgtgatgttttgatacaggcatgcaatgtgaaataatcgcatcatggagaatggggtatccatcccctcaagcattttggagtactactcagccatttaaaaagaatggataaatatttataattttttaactcaatcaaggatctgctagctctttttgtctgtcattaaaaaaaaaacctgatgttcaaatgggtagagcattcacactaggaaaatttttgttgtcacatcattagattttctgcatcacaaagtaaggcataaaactagactctgagattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctactgaatacctcagtcctgcaggagatactgatatgaataggatagtccctgctctcaaaatgaccacagtttagtctagagggcaagtagatatccctgacattgagacaaaatataactataaagttgtgctgactcaatatgtaattctgaaggtgaataatgcagtttaaaagagatctgaagagttgaccaaggccaggttaatatttagcaaacattgccctaaaatgccataggaggatctgtttttttaatgtcttctccaaaattcagtgttaggggatgctttttgacccttgtggcacataccgtggaagctatggtaattcctctgggagccctaaatattggcaagatgtccttttagctgtgtactagctaccgtcactccaaccaccatacactgagtcccctacactgaccctccaaacatgtagctttctcaagagcaagaaaaaaaaaatctgctgacaggttcttaaagcagggagaagctcccaggtcaagggaactgatccccacctttactctaaaagcaagaatattggctgttatgccagcatccagggaacatgctttcacgttctctgtagctttggaaaagggagacttttccaaaaaaagatccaaagaaaaaagagatcttgctctgagtaagagatcctggaagccatgtaccagccctgttggttatgaagctctgtggccacatcaattagatgcctgtgacttcatttgctcctactagcttgaaggaaggtttaagccatgagcatccccaaaccaggagtgccagggtagtgtctgggtatctggtagtgtctggggagctgaggggttctggggagaaaagtatggaatgtactgtatgtaatcctatgaaagtgtagtttattaatattattgttaatatttagaaggatgatcttcccagccagctattttaaattacagtgagatctctaaaacatttggtgtgtaaattatatccaaaattccaattgccataactcctgttgttctattttctctaattaagagtcattatgtgtttgtttttgttgtggtttttgtgggcaaatatatgatgttctcttttattaatactataaataatatgtacttattataagaaaaatagcattagtgtagaaagtaaaaagtagaattgttagcagcagtgaatccgtaaaggtctgcagcaactcaattcttgcctcctcaaaggaaaggattcatctgaggggcataaggcagagagagagactgaggcaagtttttgagcaggagtgagagtttattaaaaagttttagagcaggaaggaaaggaagtaaagcacacttggaagagggccaagagggcaacttgagagatccaactgccctacttggcccttgacttagggtttcatacattggcataattccaaagtttgcatcttttctcccctgattcttcccttggggtgggctgtctgcatgagcagtagcctgccagcacttgggaggggccgcacgcacagtgtgtttacttaggttgtgcgcatgctcatttgaggcatttttcttttaccagtcgagtattcttagaggaaggtcatataccagttaaactccattattttgcctcttattgcgcatgtttgaccccagttgcccaactcctgagatcatatcaggaagctgttgatcatcagcttcaagtattttctatctattgggagactgccgttccctggcaccagctgcgaccaattattattttagagagacggttaacaactgcctgactattacctgacggtcacctaatattcctgggttgggggtgggggatctctcctgccctgctcatgtctgcctagctacctattctgacagaatctgtccctcattttcagtgctaggagtaaccactgctcagatgtttggtgggtatcctttcagacctcattcttaagtgtatccaatcatatacacaaatatgcacatttactacttgttcccacacacaaaaaatggaatcacattatacacactttcttttgcacataaccatataccatgagcacctttttattttggtgaagagttatctcatttttgaatggctatgtgctattctattgtgtgagtgtgccataatatatttaattactcctcaacattgggaacattgaggttgctttcattttatcattattacaaacaaagagtttagtgaacattcttcaacatgtattttggtcttgatatctccataggatatttttgttcatcattattcataacagcagaagattagtagcaatttacctggttaaataaattatgtttaattccttccataagaagaaataataagagggaatggtattcagccactaaacatgatgctgcagtagaaatgtaaccgtatggggaaatgctcatgatataccattaaaggaaaaataaaagcaaatctcaatataacagaaaccctattttgttcaacttatatatgtgggaaataagatcagaaagtacaaagaaaaatgtattttgagtgatagaattacaggttatctttagggtgggtttctgagtaattttatctttacttttttgtgtttttctatatttaccaaacattttgcattgaggttttgctgtattcagttagatattatcttttaaatgcttacaaaccataagcagcctccagctaagcccacacattgaaaggaaacaaaagttccagaaaactgaggcaatcgactgagactctgggtggcttccgtgtccttcatcagcctgtaccaccacggcttaaggtctgtgttgatgtgttttccctggcaggtatgttcttgatgaccagtatgtcagttcagtcggaacaaagtttccagtcaagtggtcagctccagaggtgtttcattacttcaaatacagcagcaagtcagacgtatgggcatttggtaaggatgtggccacatacgacctggccctgtttcataagcttacttccacaacaggaaaccacaagagtagcaatgtccattttaaaagggcccttgaacacttacgaagttacacatatagcctgagagaagcaagctgttgaagaaggtgatttattttcttgggtttggtattaggatgtcttctacacatcttgtaatttacatcctgctagcactttctcataaaatcaaaagggataaatctactcagaggttgaggtggaaggattgtttgagcccaggagttcaagtccagctggggcaacacagttaagaccctgtctttagaaacatcaaaggggatgaaagtttttccagtgaagatttcaaataattttttaaaaggagtcattgaaagctgaatctgagtttttgctgagccccaaacgttgaaaagacatcaattttctgcatgaaaataatgggatagccattcccttctgcgctgaccaattcttagtgtaaacaccacacatgacttggtactttctttgactcgtgcctagtttcaagtagtctcctctctgttaaaatttatattttagattgggattggcaaaccacagcccaggaccaggtcagttggtttttgtaaataaagttttattggaacacagtcatgcccattcatttatgtattatctatggctcattttgtgctacaacagcagagtagagtagttgccacagatactgcatgtcccaaaaagtctaaaatgctatgtggccctttataggataagtttgctgactcttattttactaaaatatctatattaaaatttagtaaaggtcattagaaaagggaaacaattcttaaattgtgactacattttatgatattttttctatgttgtgagaatatcaaggctattttcaatcactgtcggatggacccaggataagtaatccaaatgtgactgagacctatttcatgccttagttcataagtgtaatttgatttactgcttgtcacctacaagactgcctttgaaaaggggaaaatttagttatttatttctctatgtgacacaatttttaaaactaactattccctttgtaaaagtggcattgttcgttgttaaaaaaaaagataatcaaatacacacagaaaaagaaaaaaaatcacaaagatagcattttggtgaatacttgatgccatgttgtactgattaacttttgtaccttgttgtcaaaattagttttgaggctgagtgcggtggctcatgcctgtaatcccagcacttcgagaggctgaggcgggcagatcacttgaggccaggagttcaagaccagcccagccaacatggcaaaaactcgtctctactaaaaacacaaaaattagccaggcatggtggtgcgcgcctgtaaccccagctactcgagaggctgaggcacgagaatcgcttaaacctgggaggcagagtttacagtgagctgagattgtgccactgcactccagccttggcgacacagcaagaggctgtcttaaaaaaaaaaaattagttttgataatcatgcatcaattataagtgatagcaaaaaatcaatgccctaatttaataattacagcttgtttttgaccaaaaaatagtattacccagcttgattatttaccgtatgccatagaagttggccccagatattttccagctgtttataaacactaaattcattcttaaacaatatatcccagtgaggatacccaaaatgaatcagggcctctgatagcaattcccaaagaagaaccccacagatattttgaaataagtgtgtagccttccaaagagaaagttatgaggaaactgcattcttttggattgttgttttagactgtgtgatttaaaagaaaaaagcagccataaaatttataaggttgctttattataaatatttgaaactggctgactgttgaaattttctgaccttggccagcacagcacaactgccaccatttagagagcacttgaaacatctcagtgctcttttaagtgctttacgtgttttatcctatttaatcctcacagcaagtccatgaggtgcaaataccccattttatagacggagaacctgaggctgagaggggttgagaaacttatcccacctgtaagtgacagaagtcaacttcaaaggccatgtctaactgatcccaaatgccatcctcctgaccaccatgaccagaaccgagatttcttaacctggggactgcaatttcctggatgagttttgggggactgtgaacatcctgaaactgaacacaaaaatgctgtgtattcactttcccaaaggcggccagtggctttcatcagattcccaaaagggtgcctggcccatatgagattaggaaccactgcagcaatagaaaggagaatgttgtcaatgattttatcttgaaatttccactgaagtgtaatctgattgtgcaatgaaattgttgcatgcagctgccaaagccgagagacggaatgggtgaggacatcaaccactcattcataagggttggggcaggggctcactacacaggtagttgtcactgtgaggctgacaactcacacttcacaggactagcgcaagaattgtgtcttggccccaagaggttcctctgtggctgcccttgccattcacccactttccagcaagcacagatgtacaggtatcagggaacatggggaagaaaccccaggctccagaagcaatggcacaggctcaccttccaagctctgctcatttcgctgggactcatttcccagggatccctcactctgacccatagccttcctgacctgttgtgtgaaactcactccacaaaccctgtactttctgataacagctctcttccttttttatctgggccacctcttggtgtggtgcagggatcctgatgtgggaggtgttcagcctggggaagcagccctatgacttgtatgacaactcccaggtggttctgaaggtctcccagggccacaggctttaccggccccacctggcatcggacaccatctaccagatcatgtacagctgctggcacgaggcaagtgtattctctgggtgggctggaaggggtctcaggcacatccggggtgattactgcatcaccactgggacaaagcttttttgagggaaagcaactggtacagagcaggagagaatggtcctcagcccctgccctaaaatgtttgtaatctaaaacatgcgggtgccaaacaatttactgaacaacttacatacagcagtgttctaagaacactataaatattaacttacttatgcatcaggaaacacactgaggtaagtactatcattgctgaaactaacagaagagtaaacaaggactcagaaaggttaagtgacttgtccaaggtcacatagctagtaagaagtagactagctagtgccagcgtccctgttcttaactgcaacactatggagctcctcgagtagaaaataagtagcagaaaacatctaaccacacgtagagaacacataatggacactatcccatcttctctccccctgcctcccaaacactgaataaaagcattccatgcaggtagaagataagggtatcttatggggaagacatggagctgaagcttcaggggattaatttgcaaagcatccactaagttcatagaactaatggaggttgttaaggaagtatgaggctccatttgtgccctcactgaactcaaagtctttacacacacacacacacacacacacacacacacacacacacacacacaaataggactgaaaacaccaagcagtttataattatgtgcccaaattagaaagacaaggtttttgccataactttcaatggcaaaaaacgtgattacttttgcaccaacctaatacaagaagcgctcagaggaaagagaaaccagcttcctgagagaaagcagcttcttgaatgcattggtacctgagctgaagcaggaaatctctacaaaatttcctaagtatgtgagtggagacattgtaaaagggtgtccaggtgagaacagcacaagcaaaggtgtggaggcaggaacgagcatggcacgctaggctggtgctatcgttggaagggctggagataagtttggaagagtaggtctggttcaggttctgcaaagtgaataacaaggagacaagtgagagttttggtttttgtaggcgatgaggagccactgaagacttttgagcagtaacatgataaaaggaggcttttgagaacattattctaagagcccatgttcataatcattatatggtacttcctcaatggcaaagggcctaatgctgcattcatttattcactagtaaaaggcaaattggtgtaatggttaagcctgtgggttctggcatcagaatacctgggttgaatcctgtcgtgatcacttactagttatatgaccttgtacaaacctcctattattatctctgtgcttcactgtaatgtaatgcttacctcatagaatttttgggtggattgaatgaattagcattataaaggccttaggacaatgcctggtacacagtgctgtttttctgttattaatattgtgtgtgtgtgtgtatatatatatatatttttttttttttacaaagcatctatgcaccaggcagtacgcttggtgctaagaataaattgacgcacacaacttaaatagtttctaaactcttgtaccggagcctagagtcccactttggaagagttgctgattgcatcacataacaatatttttcgtttagccttaaattatcacctggaatatgagcactctgtaatttcccaccctatggcatttggaacagtatataaggtttccacacctttttctaccccaaatgttgactatgggaactatggatatggacagagatatgcagactacagtggccaacagagcacttatggcaaggcatctcgagggggtggcaatcaccaaaacaattaccagccatactaaaggagaacattggagaaaacaggatgagatgttaaagtaacccatcttgcaggatgacatagaagattggtcttctgttgatctaagatgattattttgtaaaagactttctagtgtacaagacacagtgtccaactgtatatggctgccaattagttttctttgtttttactttgtcctttgctatctgtgttatgactcaatatggatttgtttatacacattttatttgtatgatttcatgttaaacttcaaataaatgcttccttatgtgattgcttttctgtatcaggtactacatagctctgtaaaaatttaaagtaagcaataattaaggcacagttgattttgtagagagtattggtccatagggagaaactgtggtcctttataaatagccagccagggtcaccctcttccccgatttgtagatgtattctatgctcttaaggtttcatcttctccctgttaactgaggtttctaccacacttttgaataatgttctttcccctctggttatctgaagattgtcctgagaggaagacataagtgttgtgattagtagaaactttctagtagaccatgtttcttctggattgtaataaaattgttagtagctccttttgctttgttcctgtctctagaaagccatctttgaatcgttaattactttggctttaatcagtggtcacctagaaaaagctttgtaatcataacaccatgactttaattcttgataaaaattcagatgcacacaggaaggagcactgtaaaactggtaggagctatggtttaagagcattgaaagtagttataactcaaggattttggcagaaaggtatgagtttggtcaaaagttagattaaaatttgaaatagcggcaaaataagatttagttgtattttgttttctcacagccaccacaagactgaacaaaatattttctgtttgggcattctgaggaagctgtattacagttaactgttaatgctgtgtgagtttagaaaaagtcttgatagtaaatctaacttttaacacagttagtgcatgaactgagtagttaaacatttccgtattcagacaggaatagtggaaaaggtatcttaggtgcgttactcaatccaaatgtgactgaatcattacagtggaccctcatggtgcattgaaaagaaactgttttatatccaggtttcagaggacctggataaataaaagctttggattttgcattcagtgtagttagttggattttgggacctttgcctcaatgttagctactgggattggcatatgtgttcacaggcagagtagttgatctcacacaacgagtgctctcacaaaactggtgtaagtttcttatgctgatgagcccccgcttttttttaatttggtgcctacaactttgttacaatgattgtacttgctgggctatcaagttacaatgctcttggtcttttttgctgctgtttcgctatttgtccttacacctaggccaagtaccaatgttagctgttggaagggattctgtttattcattcaacatgcaactatctaactttagggaatggaaggaagttcatttttaagttgtgtgttgtcagtaggtgcagtgtctagggtagcgaatcctgtaagttcaaatttatgattaggtgacaaattgacattgagattgtccttttccctgattaaaaaatgaataaaggctttttaaagaaacaaacaaacaaaaatattgtgtctaagattatcaggcagcactagagggtcagactgggtctgggtagagttggtcacagccaggctgacttactgctgtcacctgtcagatgaagaagagcagacaagggtttttcagttgaagcccagaacctccctggccctccctactctagctcctgggaatatgactgcaccataggatggacaggggccctgagtcgggaggaactgccttcttctcatggttggttcataaaagcatgtgaattgtggcagaatctgtgaagaggggtttgcactgagacgacaatatccagttaaaacattgcacctaatgagcagagcttatagatttgggttttccctccttttttagattttattttgtgactttctcaattcataaagagattgaaagaacattcacaattttcattagattttgattcatccttctggtatttctgtatgcaaaaacaagcatatgtatagatgtgtgttttcttgcttccctttctctcttacaaagaaaaagtagcatatgaacttctcctctccataggcgttgcctcactagcaatgtaagagggtacctattttcttataacctcaccaatggagtgcattgtcaagcttttgaagaattcttgccaatctgataagtgaaagcttgatggcatcttagtgcagctttaatatatatatctttcattatgaggttgagcctcttttcacgtttttaagggtcattttgtgtctttctgaactgtcatgtcttttttcttttttctgtcaggttttaaagatctctttacaaattagggagagtaatactttaagttatcagctttatttgattgagggtgggtgggtttttttttctttttttgaccatgcagaaatttttcttaatatagctgaatatatcaatatttgttttcattgcttctggaaattgtcatagataggctttctcatgcccaaattataatgacttttgccaggattttcctctagtacttttaagattgcattattttccatttatgtttctgatatagtttgtgtttgttatggtatatggtattaaatatggctccaaatatataattttatgtgactattctgttgttggcagccctatttattaaaagaccatcttatcatcaggaatgagataccaccttaatggtggtgaaatgccaccctaatattatactaaatttccatatgtacttgaatctatttggagacttcctcttctgttctttggtctctttgttcatgtgctagcaccacactgctctgattctgtagagactttatgatatgtttgaatactaggtaggctagcacccctcattgctcaccttactgtataatttcttagccatttttacatattttttaattctataaaccaaagaatcaatttgtttagcttgaaacaaactcattcatatttttgaggagattgtatttagtttgtattttaagttgggaaatttgacatctttatgatactgacttgtcctagtctagaacgagggaagctttttttttttttttttttttttttaagacagagtcttgctctatcactcaggctggaatgcagtggtatgatctaggcctactgcaacctccaccttccaggcttaagtgattttcatgtcccaccctcccgagtagcttggactacagttgtgcacaaccacagctggctaatttttgtatttttagtagagacagggtttcgccatgttgttcaggatggtctcgaactcctggcctcaagtgatccactcacctcagcctcccagagtgctgggattacaggcgtgagccactgcgcctggccagggatgcttttttatatagtcaagtctacatttgcatttttcagcagtgttttaaagtcgtccccattttagaggggcacacttttttagtgttttattttggtggcgttgctattataaatggggttttctcttacatgataacttctaagtggttactgtaggtatatgtgaaggctattgattttgtatgttaattttatatcctgctctcctagtgaattcctttattctttaagtctgttctaacattgatactctcagattttccaggtatacactaaaatgcttgcaaataaagagactttttcttttccagttattggggctctaattgttcttgctttccaattgcattggttaacaccttcaacataatgttaagagtgattattatagtgagcgtccttgccttatttctgacctcaattgaaatgtctgttgtgtttccacattttaaaagttgctagctttaggacttagatgtaaatattttatatattttatcattgatcataactctcatcatctaaaacattgggtttcttgttgtttttgtttagcttccagaaaagcgtcccacatttcagcaactcctgtcttccattgaaccacttcgggaaaaagacaagcattgaagaagaaattaggagtgctgataagaatgaatatagatgctggccagcattttcattcattttaaggaaagtagcaaggcataatgtaatttagctagtttttaatagtgttctctgtattgtctattatttagaaatgaacaaggcaggaaacaaaagattcccttgaaatttagatcaaattagtaattttgtttatgctgctcctgatataacactttccagcctatagcagaagcacattttcagactgcaatatagagactgtgttcatgtgtaaagactgagcagaactgaaaaattacttattggatattcattcttttctttatattgtcattgtcacaacaattaaatatactaccaagtacagaaatgtgga

SEQ ID NO: 1086 - DNA, 49210 bp, Homo sapiens
atactttaacctagtttacaatttatatttattatgcccactgaacccacaaaagcagtgtttaattttacagtttaaagtcacacatagggaaatgctttacaaaataggatattgttcctcaatgaaaatattacagtataggtcccaaacggctcagttcaagtcttttacctgaataacagagctgttgtggaatgcaggctacaagacacagtaatgctttaaatagttgattaagatttgaaggttgccaaagctgagagacattttaaacaagacccgtcttagttttccaagatttttggtttttcaactgcattatataccattgcttctggaaaattgagggtaataagcagcgtacattttacatcttatatacagtatgtaaatcttcaatgattttctctaccatcaaagcaagtttcaaggtttaaaaatctgttatacctacttaggtttattacttgactttactcacagactctaatatagaaaccaaatatttatgcaattgcttctatcaaatgcaacatatttcttcagtctatttagttatctgcaaagtctatttacaaagcatatgtatgatttcctctgactaataggtcatacaaatacgtaagtagtgtttttcaactcgtaattgtagcaagatgagccatcaaggtttacgttgtgcctgagtgtataatgcaaaaatagcatccagagattatatatttcttaatcaaaagtctagctttacaaagtcacatacagtatgttcttctattgtaaatatactctcagtataggtagacgtgtttctaatatattgtgagttgttaaagaaaaggctgagatatagtcaccaagtgtttaccaataacataaattattgcaaagcttgaaaaaaaatcaggccaaatatacacgacagtttgaatggaatgctgaggacttagtgaatgctgaaatatgactcatctaaaagtctgctactccggcctgatgctcctcaaattttaatgaccccttaaatgtcctcagatgcacatgcagtttacgtcactgaccactgttggtcaaaacaatcattggatgtgcttatttttcaaattttgagtatcaagttgtgccctaccgtgacacaaagcttagaggtctttcttgcaaactgtaaaatcatgtagaaaaatagtaactcaaaaataccacatttgacagtcggtcacgaaagatgttagcacctcaataaaaattagaattgttcattgggtgtgccaaaggaaagtggaaaaaaattaaaaagcatgccctgttttttatttgttttttttttttttcctacaaatcacagttttcctcacagtgttagacttttaggtcactctgatgtagcagtaccttacaggatgaggggccactgctcgttttttccatttgacctttacagtccacatggtccagttagttgaagccacaaaataaagaccagagacagcaaaattattgctaatgtgcaactatattagtagaatgcaattaactgggctaactaatgtgtatgttaatgtcttttttttttcaaaaccaacatcatctaacaacatattcttttagtttttccataaaacctgcattgagaatgatatcatagccccaggcaggcatttaccagactgaatgttttgctgatctgaacactacctgtattccaattttttggctaatgcatggttttgtatttcaatatgttctcatacattaaataaatgaaacacaattatacattatagagtttatatgcatcatgatgatataatttgagaaattatctctatagattatgctaacaaaggattcttaggaagatttttcaatgtactagccagttaagttgatctatctgtttgataacctaaaactatagattgttggcaaatgagaaaaataatagggaaaacatacaagttccttttctgtgtgtctaaatgatacattgtcttgaatttggttctattaaagctttaaatgaccatttctgtacacatggctatttcatttatttagtagttttgaaatgttagcaaatataaggtatttgtaaagcatctttcattataaagagattagtaatattcaccaatcatgccaatgagattatacactctgccaaagactactagaaaaatttgatcattattaaattcaatgttatttgacagtgtgaactctatgtaacagcacaaattctggactttgaatctggctgctgtcctcacctgaaccattaaaatgaccttgttaacaaggaaggaatcaatggggaaatatcacaaccagagattggctgtgtgtccaagggtgctttgtcttgttgccaggatcagactgtgaaatcacagaggcaagctgatgtcatcagaggtgactctgcctatttcaagtcctataatcaccccatgggattcaacagcagtaggaaaacatcacattctcttaatggacaccccatatttgtagaaacagttatgactattagcatttgttatacaaacccaatctatttgtgctcatctgtagaatcctacagacactagagactaaatgatattaattttaggaggtgtttctaaaggagaaacagacaacatttggttttattatcgtttgtatccctcagaagttgtgtgtagacaactttcatctaatacatcaatatcgacttgtccaagtttctcgatgaagtgaaaggatctgattattggctgtgtcttagcgtctgtaggaagcttctaggctatttgtgtacccaaatttaaaacttgcaccttgtttcattgaataagtgtttttcttatttgtgacttggaaaaaatagtgttaatgtgatgtaaaaaacctattatcataggcacaagtaatgaacactattggtcatgacagattaaaatttccttggaaagaaaaatgatagtatcagaataagaatacatgaggaatatatacatatacacctgcttcacacagaaagctttctgtaaaaaaatacaaaagcaaccagtgctgtatattatgtaaactcacaaagtgtaaaagtgtactttatacacaaacatgaagcataaattaaaaagtaggacaacagcaaaacattttaaatatagaaaaatttgaacatatttttgttaaataagaataaataattttatcacacaaattcacataccagttgcaaaaacaataaattactttttttcagtgctgcaactttttttttgtttgtgatttatcccctaattcctagtttagtgggataaaactgtttccacaggaaggcaaaggaacataaatttattgaataaattataacaatgcccacatatttctaaacagcaaggcagggcttaatttaaatttttctgatctagaagaaataaatgtcattttttctggctccctttgtacttaataaaacttattatggagtgcttagttatgtaagtgagattagattcttacaaacctgagcattttcagacgaattcttttttttttttttttttaaagaagtagcccctagcatcctgaattctagacattttaaaaaattcaagatgcaacaatggaaaggtgaaagacagtacgaagtcaaagtggactgacttagattgagttgtatagaattttccctttgttcacaattcgtggtatctattgaacactccatttctctgaatttcagtttccaatccatatcatcttctccaggaatttagacatacattcctcagtcaatctagtgagactcataagaaaaaggtggagaaaactacttaaaagcatggaatagtggtttaattgctctgagctctctaggattgtttccatgacaggtgtaaaccatcactatttgagggaaacatgaatcattgataaaccatattaaaaatgtatgagtatagtaagagaagcagagtaggagacaactacatttatgcctcgagtattttttaatgttgttgggaatataaccacaaaaaataaaaataaattttgtcacatttgagttacttgattaaaattatttccaaaatggaaaaaagtaacattaacctctctcctaattctctttgcacagacaaatggcactgggattattattttttttctcacctatttaactaggtttgctttctgcccttggcattgggtgatctccatcacatataggttatcagccttgtacaggcctcatttctcaaagtgataatttattgagaaaaaaaatttctacgtcaaaagcaaagtcagtctatgaaaattcaaaggataattattggttttgtaaaacaattatttgttttaaaagcaatttcttaagaaaatactgaaaacagcaagacatctattttcctggcccactgaaatgatgtaatatagtgatcagttacataattcttttatattaaaaacatcttataataaaaataaactctcatgagcttgtagaactcaaacagtggttccctaagatcttcacatgcaaatctttaacaataggcacatttggcaggattactatgaatttttataaagaaaaattggctttgcagtgtttcacaacaaaagaaatcccaaagaaatcaaacaacttagattttctaagttgtgaggttggtgatgggggggtgtacattttatcatctaaaaagatatctttaggtgtgtgcttataaaataatttccatgtctaactattcaaacttacaacctacttaaacaggctatggaaacaaaaacaacaactttctgaaaatcatcacatgtcatcactcaaacacttacgggtacaatcaagtgctttccagttgggaaaaatatttagtacaataggaatatacttagattttttaaattaagaaattattgcctatggtgtggaaacagtcttattaatattaaccactttttggcattaaccacattaacaatgataaccacttctcaatgtggctaactaccaagtgatctttaatgtttctaataaaataagtcaagaaatacaaaacattgtaggtcttactgaacccttgaacaaaacaaataagcaaacacaaatgcattttaaaggcttgctggtaggaggtataccagtgttgaatgtgttggacatgatagaaaacttgctgtgtgttttgtacgtatatcatacattgtgagatatcagatgaaagctctggagagagaaagtagttgtgaaaatataaattgaaaacacagtgaaatacgatttttttccttttaaatttccaacacaaggaaactagtttttagactcttgagtatgatcacacacacacacgcaaaccctacttctacatctgaaattatgcattaatttggctagctacctgaaaaaaatacaggcagtcaaaggtttaagtaaatgaacccgtgtatgtatttaagtgactagatacactgagatctatttacttttcaaaatttctcagaagatacttgctgtcaaaatggttttttgactgaaattttatctcctgtagtcagaaaatatactacatcttattaaaacagcagcaagttcttaatttccagtaaaatatccacagctctttctggaaacggaaggaagttgaaatagctgcagacctactttggtcaaacactttttttatagaaatatatatggatattttaatagaaccaggggatataaagtgacataccaagggagaatgtatttacaaacagtaagaagaagctactgtgtattatgggtgaaaatgattatgataccattaaagacattctatcagaggtaggtgacaagggggagacagttctgccatcttcaaatgtcccctgattttacattcatcagtgtttcttgtaagcccaggggatgttcaataactcccaagtttttctatattgcaaggtcaccactgtcacgtgaagcagtgcacatcctcttttggtcacagagagcagattctgcccataattggactcctgttgacaatgtcactgaagcatgactttctgtgcgttaggtagacctcctgttcaccacgactgcatcagtgctgaatcctccagttatctttgtgcataagatcataaccacaggctaacatttcttcaacaagcattgcttaaacgcagaaggcctttgggagagaggacatccttttgctaacttccggtttccatcctggcactgcaccgttctggtgtgccaacctgtgtcacaggtcctagagcaggcgagccatgggcccgtgacccactgcggctgcgaagtgtgtgatcccactttattgctgccatgactagtgacagagtttacttttggagtggacttcttgggaacaaaaaagctataacggacatctaatggtttagtggggtctgttgcaagaatctgcactattagaatttccttcgtggcagagtagcccatgccatgcaggaagtcatccctgtggctccaaccgctatagttcatgactgttccattgatgtcaatgatagtctctgaagtggagatcatgtactttccattgataaggtactcaccgtttttctttttcagggctaaataggcagtgaatctagtctggtctttggctttgaactgtcgaacttttatgtgggttgccccttcaggaatcctcaccacgtcagtgtaacccttactggaagtaggaatgttcacaggaagtgggggaaggtggttaaaaaaagggagaaaaaaatgagtaaacacttaacaaataaatacacaaacagaagttctctaaaaagtcttctcttaacacacagttttaatggattagtttaaaattgggtttaaaaattattttttatgagaaaattgcaattatactacagtattgtatacactttaattgaggtgttcaaaattaggatgatgctagcaacctgccttcatttaaaacatttatactaactttcaagatttatacaaccattttcatccttatcagatcctatcatctttacaaatctactttccattctttctggcacaaaatgggatctgtttaaacacaaactgacaaaaatatgccttcacttaatctcacataattctttaatatttctcagattgcttccacattagaatcacgtggggatcttttaaatctttcagagcctacccacacctcagaccaattaaatccccatcttccagggtcgggcacagtcaagagcacttttgaaacttctcacattgttccaatgtgcagactaacttgggaacacagaattaattagtttttggactagaggtgagtagagtctctgcattcctttctactagaattctggatttggtgggacaggccataaatgaagcatgcaattctgaaattgggtaatgatattactaataccatcataaaaggggaatttttttaaatgacttagagaatttttctgaattcttagtgcccataagatacgatagattgagaaaggctttatggtgagtgacatataagtcttcaaagagccatcatctggacaaaaaaatggggaaagacacaaatatctttaatacccataaacctgtgaggaatgctaggatggaaatgctaattaagcaccaagggtgaaatgacgagtcaacttttgtccacatttttgcctttttaagtaatttcataatagggtcccttcactttcctagttatttaaacaggaatactattggcttgagcagtttgactgacgtgtggagctgaactgtctcatttccagttctcattcacatgctaaaaatccaagtgtgtttcccttactccagagtttcctctgaattggaaaggaagcttatcgccaaggaagtcccctgtctgcagggcaatctgttctacagtgacagccacacaggtggtaaagcttcctacagtgttgaagagagatgatgcaatgctcagggcgttccttattctgtctaactcgattcattatttttatttttgtaatacattacagatcagattttgttacagatgtgttttgtagtacctaatattaataaataatccatgaaactatagtggcttcaaagaaagtcaaaagggatgttggagaattcctcgaggtcaggagtttaagagcagcctgggaaatacaggggaggccttgtctctacaaaaagtaaaagagttagccagggatggtggcgcatgcctatggtcctagctactggcaaggctgaagtgggaggatcgctttagcccaggtcttggctgcagtgagtgcaccactgcactccagcccgagtaacagaatgagatcctgtctaaacagaaggtagttggagataaatataacatcttacacaaaaagagtatgaaatggggatatatgacagtatttgaacaagttcactttagagctgattagtggcagtgttaggcttaaaagccaggcttggctggatgccgtggctcacacctgtaatcccagcactttgggagactgaggcaaggggatcacctgaggacaggagttcctgaccagcctggcaaacatagggaaaccctgtctgtactaaaaatacaaaaagtagctgggcatgctggcccgtgcctctaatcccagctatgctggaggctgaggcaggagaatcgcttgaacctgggaggcagaggttgcagtgagccaagatggtgttattccagcctgggcaacagagtgagaccctgtcttaaaaaaaaaaaaaaaaaaagccaggctcttgactcccaattagcgctctttttcactatatccccaggcataaaatcctgacccctgccagccatatgttatagcagttaaatgaaattaaattctggttatgtgcagagtttaaatgatgcccagtaaggagtaagtaaaataaagaataaagggtaagggaagcttttttgggtgtttacccttgttccttagagcttatctcatcttgatgagaattagtatgatggtcagtattgctgcaggtcttcaaactgagtttcacaagcactagtaaacctgagtattagtgccctgattttttagtgccttagtaagagatgattctcttgatattcctgattccttttctttacatcctgcttggtatcatttaaactccagacactaaccagctttcccgactaccataagtgaatgcaattttcatacaactcttacaaagtatggctggcagggcaaaggaatcttgttttgttcagggctatctgcacagtgccaaggacaatgtctgtcatgaaaaaatatattcatttatattcaagcatgctctcagggaagggatgttttagtccgctcccagcaaacaaaatatgtggtgatatcaattgataagagctgtgaagaaacggagtaaggtaagaagttgcacagtagtggtgggagtggaggagatgtcctcttgtacatttacggtagccaccatctggggaggtgatatttgacagagacctaaagagattctggaaagtgtactgctcattaatagcagaaagtgttccaggcagaggaaacagcattctcatacctggtgtcatgtttttgaagtgcgagaaagtgcattctggtcagagcagagcatgagaaagggacagtgtagaaaagacatagaggagggaaggggccagatcttttagcaccttagagattacaaaacagtcttgggtattgagtctaagtaagatggaagccattggaggctactgatcaaaggaatgcaatgatctggtttaggtaatagccatggcttcccttgcttggtaagatgagattgaggagcaaaggatccagaggtcagcgagaagactgcagtgttagtccaggcaagatctgatgaacacttggattgcggtgggagcggtcacggtggtgaggggcacccagattctggagatgtggtggaaatagaactgacaggatctgctgatggatggatgtggggtgtgagagaaaatgagacgtgaaccatgcctccaaagttttggcctcaatagtagaaagactgagttgccatttactgagatgaggaaaactgagggaggagcgagttaagattagggtcatattgtgaatgggcttaaaattgatgaaatattttaatatgtattacctcatttcaccttcacaacagttttattaaccatatgataataattaccagtatttccactttacttttgagaaatctcctggtaaagaaattaggtgacaattcaaagatcacatgtctaaggaatcattgagccaaagcttgattacaaatattgcagtatgagatcaatgttctttttcataaatcatataaattactatggcctccctaggtaattaatttgaactactcaaacatgtcatttgtaccatagtagaatcttggtcaaaccaattttcaggtggttacattgcataccacttgttgctataatgaatttcttctttttcatgtgaaaaaatgtgcagatattagttgtcagcacaaaaatacttaaaatgctaaatttagcaattttaaaactggtttataactttatatagaagagaatatgtaccataaagtgtataaggtattactttttaaaagtagttttgtttctaatttgattcctgaattccctctctccctcctttcctttttctttccttccttccttccttcctctttctttctctttcctttgtctttctttctctttctttctttctttttctttctttctctctctctctttctttctttctctctttcttctatctctctttcttcttttttttttcaaagtgacctgtgtattctaggatttcagttatggtgtctgctcttctctggcattcatcagccatggataattggctaactcctatattttcagagtccaactcatttttaaaacagaaggttggactgatcatctccaaggtgttttatacctttgaaacatataaaaatgcaggatataattgggcatgcagggtttttgacatagatggtctaacacaattaggtgaataattatttcattagcaaatagaattagtaacgcatattttaactcagaataaatttttcagccatatattttcaaatcacatcagagaaaatttatagttttttacattaacatgtttaattattttaataaatcctattgttaatttcgtttgcatattactctcaagttacagacaacacagcacgtacatcaagaatacagatacatttgactaataacactcagcctaagagtggtttgggaagaaaagcaagcctgtattttaccagactctagtcaactcagtcatcctacctgatagcatattttatgccggaaattggtacttcataaacttgaatatttaaagcaaaaatctaggaccataagaggaagcaggagagagacactgctgtatatatttctttagagagtagatataaaccaggatacttcactgttgcccacaccattgcaatgaacttacattttgcaaggggaaatattttcttaaggaaaacacagtgtaaggataatttgtttttaaaaatatagttaagatcaaaaccaaccaaccttccctaaattatgttttaggaataacactagatctgcaagatatcactaaagtggaatgtcccccactttttcttttcagttttctgactctacaagctattgattcccatggctactgcagtttatctgcttccagaggcagcatgagttttccctgagcaaccagagttttattcatctcctgtctcttccttctcatatttaaaatgtgtttctagagccacgttagacctcctcatacagatagcttatgatgtaatatgaatcctcctttatcaattctgcaagagtctaaagctttgttcaattcacataaagacaaaggttctatcatattaccttttcttattaaaggttccaacaatctttgtacagctggagttgtctcctccacatactccgcacttgtcatactgcagctttgagccaatgatgccgtcacagccagttctcacacacttcccccggacgcagacggaattactgtacagcctacattcagtgccatcggtcacctgaatcatggcaaatgcattaggagtgggaaatgtttgcatcagtatttgctcctttggtcaactagtaagttctcatttgtgattttttgagtttgattggtatggacagtccattgaaaaaaaaaaaagccaaaaaaacatagtttccagaagtagctaactgaaaaatccttgtcatattgccagaaagcagattttggataagcctaggttacacattttctctcttaaccttacctctgaatgtgttaagagacacaaggtactcatcttcgtttttgtatgcataatacattctcactagaagtaatcttttcacttagtgtttcagactatcatttgtgtgcagaactgaatatgagcaggcttgagaatgcaaagatccttctttgttgcatagttgttattataatgacaaatttgaaaatctaaacttgacattcaaaactgtgtcatggttggagagcattccctattgtgtgttgaactgtcagacactgaaatcgacacaaccaaattagtgcagaaaaaggagtctggggaagttagatgaacggacttactggaagagactgaatatattttgaataaacggattagtgtatagtttaaaagctagttataaaacagtgtgtatatagattgtggcttgtgcatgtgagtatatgtaatatatatacactcatatatataaataagcctgtaaattttatatttatgtatatagaaaactctttttatgcatgtgtatgagtatgttgtgaatgcgtgtgtgtgtgagttgaagtagaatatactttatcaggttaatagctctgtagatggtggtattttcaggtgatttttatgtttttacttctgtgtaatatttttgaatgaaaatgcattattttctaataaaaacatgagctttaaaaaatttcataaattgacattagcttgtttttcaataacatattataaatatctgaaggccaagtttcagaggtaattttttttttgagacagagtctcgctctgtcaccagactggagtgcagtggcgtgatctcggctcactgcaatctctgcctcccgagttcaaatgattctcctgcctcagcctcccgagtagctgggattacaggtgtgtgccaccacgcccagctaatttttgtatttttagtagagacagggtttcaccatgttggtcaggatggtcttgatctcctgaccttgtgatctgcccgcctcagcttcccaaagtgctgggattacgggtgtgagccactgcgcccagccataggtgattttaaatgtagcaactgtttacaaatttgtaaattgctgtataacactgaccataagaataaaactctgctatagatttagaaaatgctcacttgtgaaaaataaggcatgttccatacacaaatattatacacatacacaaggattataacatatataactagagggacattgattcatattaagggttcttgacttattcaaaagcctgagtcagaggtatatgatcttgaaacccatctccacggctcatcaaaggaattcttaagtaaatcatagaaaaatagaaaaagttttcttgctttatggtctcctttacaatgctgcttaggaaatactagttgttttcatggttactttaaagttaaggtcacactttgccttccttgacagtgagttacaccttttacagtgagttacaccttttaaatatagcttttaaaacatttacttgttctgtttataaaataatttttattcattgtgtaaagtttgaaaatatagaagttatagagatgaaaataaaaaccttccaaaatctaactgaccccaaactaataactgtttacgtctggcgtccgcaggcttcattctaccaaataatttccaccagtacgcctactgcttctggacagttggtgtgtagttacctttggagaaaataccacatagtagccagtgcccttggctctgcaggtcagcttgcacacatccgctggcaggacacctgcatatttgggaacccattccacaaaagttttgactccttttgcatcagactgatagccatttttggcctcacactgttcatgacgaaatgatttacctagaaaacaaacatgtttcagtattaccttatcagttctgaaacttagatatattcttgtgggtttaaatagttaattttaaggggaagatgcaaacgtgttttttttatcccacagtctctttactcaccaatgctgatggattttatctatacatagagttcaaaatggtgattatttattccaattctctgaatattgcttataataaaacttaaaaatcacatatgtggctgggcgtggtgcctcatgcctgtaatcccagcactttagggggccgaggagggtggatcacaaggtcaggagtgtgagaccagtctggccaacatagtgaaaccccgtctctactaaaaataaaaaataaagaaaaaatagccaagtgtggtggtgtgcacctgtaatcccggctactcaggaagctgaggcaggagaatcatgtgaacccaggaggtggagattgcagtgagccaagattgtgccattgcactccagcctggacaacagtgtgagactccatctcaaaaaaaaacaaacacataggtgtttgttattgatctgcatattggtggaactgtgcagtataagattaatattatttccccagcttcccttattcattattgctagaatacaaatgacatgtagcatatgatggttgctgacacttgggagcagcgtaccattgggtgggcagggcatgagactgcaggagcggtagatggccctcttccctgtgcagtagcgtccgttgtttctgggagcagggttattacagtgacgataggcaaactgcactcctcctccacatgagcgagaacactggccccaggatccccaagatccccagttgccatggcttgacgtctgaaatagagaatagaatatattttaactccaatgagagaaaaacattgaaagtgtgcatttggaaatcacctgcatttaatgacaaagtggaaactttgtcacagatacagttatattttcactgaatttaacatgatcatgctttggaaatgcaacacatttccagtgctaagcaattcatcttttccaccctcccaactccagcactagaagatctgaaagcatcatcctaagtactgagcacaccacaaagattatcaccttttggtttctacggaccattgtaaattatgtcttctaatatggtccatctctgttaatatcactgaaccatggtaactttttgtccactctgatgttggatctttattgaaacgtataatgctgaaggatctgcatggcactgggcattatttaattgtgtttgcatctcttcagcagtaaaactctgcagtccctttgttgacatcccacatcctgtctgtgaccgactccatgacgttcataaatgtaccggacccaacttggcttaattcctaattagatgtgacagatactgaaatgcactcacgccatacatgcagacacaccccttagggaaggaagagcccttttatggcaacctaagtctgtttctctggaaacattcctggagggagcttagagattctgaaaggaagaatatgatcagctgctttgctgagggaatctgtgaattgcctctggctgactgtgtcaggttatctgatgatgaatggttgggtgatgccctggaaagatacaggcaatgggcacaggataattctcttctagggactttgcaaatcttgtgggttgagagcgagcacttattttacttaggcctcgaaaattaatagggcagttgctgacctgaagctggactgtgtatatagtggcagacgtgtttccccggagcagtcgtaagttactttagctcctaaatttagattaacttattgtcaaggggaaaaaagtgaccatttggagctcaccaaatatgtacaagcaccacatgtatcggctctgctattacctccttactgaatttaaatacttatattctgataactttagcaagagaagcttgaaagtaaacttcccaaaagcaattaatagggtcctacctgaggtctcaattagacagaatctgagttacataagtatttgttaaaagatgtaaactgcaaataaattcccagtatctgcattttccccagtaaatctcggatcactgagaatggctactgcgggtaaaagaagaagctctaaataaacctcaaaatgaaaagtttttaaattagaaaataaagccttctgagaacagtgcccatacccatcacaagaatgcacttcacttcttgggcctccaggcattgactgatgagaaaatcacttactgaataatattttttcttggttttgtccacacatttgccctgcaggcagattctcccctttccacaaggcgtcccttccaccgcaggcagcttcttggtcagacagaccatctggccctggcgtaccacagcacaccacaggcgagcacagacatccatgccgggacacacggagtactcaggcccgaatgtcaggttgcactgctgggtggcatcgtaggtctgtcctgggagttcttcggggcccaggatctgctttcgtggtaggtccagcaaacagttacctacaagaataactgagattgaccacggctctgtgtttaggtttcaaaccgctaaaatcatggatctaaaaatgaaatgccccggctggtgttggagcacgaggcacccatgaatctgtagtgtaatgctctggagagggactccatggggacaaggctgggagcccccttggacgcaccagaccctccagggttctcaggagtgatgcgctccggagtgtctgtaacaacagaggtgaggttggcaggggtgtgatggaataaaatgattctgtaatgattagttgtgaaaatagcccttgtgctaaggcactaaacaaaattgggatggacctagagaaaatcagatggtgaattttaataataataataataatgataatgaagcatttactctaccactttgagaaacagagtttgtccttggcactctatctgtataacccattacccatttctaactcaccccttccccatgtgcctatcacatgtctcctttccactaattccataaataatagccaagctggctcctcattcattcttacagtcactcgacaagcatttgttcagcacctacaatgttctagaaaacacactaggtatctgaaatacagaaaaatgacccagatctacctttgaaggccttccaataaagtcacagagataaagtatttctctcagactgatataattttaataaaaagttttcaagattcacagaacaaaggagcagtgaaaaaagaaaaaatagtctttgataatttaggattaagttagtctttatactctttgctttatgtctatttaatggaattggtgtttgttgagtatttggatctatctgccgaaacaaggtaggcatctcattgcatcatatatgagggtgtacaggcagaggggtgagatggggaatccacaaaagctggaacatggacgatgagaatccaaaaccttaaatttgcttcctcttcctctccttcccctccccgcaaaagcttccctaagaatccctgtccggtgagttaacatcattaattttcttttgtcacccacatatgcatgcatattgcccatctgtttctgtatttttctgtttactttattttaggatttacacaattattataatagcaataaaataacaaatatttgttacacacactattctccattctttacatatatgagctcatttaatcctcaccacaaccccatcaggcagattctagtgcatattttatttatcctacagataaggaaactgaggcccataggaggcagaccagttacccaaggtcacacagctgttatggtttcatgctcagagcctgcccttttcttctgatgccatatggcttctgttagcatgtgagtagctgcctgattgtattgctgaagggcagccatgtgtaaggatcctttaagtggtagatattgagcttaatggaagaaacacccagtctgaagtcttactctggtgaaatactaaatggttgagtgctcctggctaagttagctaacctctccctaatttattttcaagatctgcataatgcttctcttctcactgtgatactgtaaatgtgaaattagctaacaaagatcttaagggtgaccagaaaaatacaaagcaatggtagttgtatcccagtatatttaacagccttttagatgtactacagttattctttttattcaacaaaaaagtcatattcaaatccttatgtgccactgagaaatagaatattcagcatattttaagtatactgtaaatttttaaggactacattcaaatttcttcaaagtgaataccttagaatttgtcaatctgtgttgggggcattatataaaaatgaataaagagcaaagttcctatttaacttctgagccagaacgtttgaagaggtaaagcttcttaaggcaagccagaaaaagcattaaaaataagaatccagccaaagagaactttgggagaaaaacaccaagttaaaagaaaaacacgaacatcaagccgataggaaagaatgatagtaaaagctcactaagctttgtttataagacagagtgcgattagggcttcagaactccacgaaaaacattatcttcattgcagaatcaaaaaagaagtactgtgtaaactaggggatgcttggcagattgctgatgttagaagactgtcaacaaatctctgagtctgcaataatgttttccagttcttcaaaagtgctgttttaagaaagtttttaaaaaaaattttactaaaaagcacagaccataagactgggtaactaaatattagctaggaagtctttaccatgtgtgcatgcacatggcatggatctatctcatttttctggagtcaaaataactcaccacctgactatgcatacacagtcactgacacctgttctacctcactagtagatgacaagtgaaaaagaaacgtgtaatgcaatttgaaatcggcttccaacaaggagacttcaagatgtggcatctctttaaaaagcttaacttagaactgtaagttttaaaaataaataacacattagctttctattcaaaataagatatatcagctctataattttcccttagaggtcatacatgtggagatgatcttctcttgcttaaaataaaataatttatttcagaattgcaattaatgtgttatgccaatgttctcagtactaggatttgtagctgcatcaatttctgtttatgccaaagcatatataatttaatttttacattgaattatgtccttttgcaacaaaataggtacaagcatctctaccaaatggcagaatggtgccaagaaacagtaacaaaaatcaatacagagcctaagtctgaaactcacagtataaaatgtttaaaatctaagtaataacagattggatatacattttatatgtttaagaaatgtatacagtttggggaaggagtaaaaggggaaactgatcaacctttcagtatcatttctagtgagctctagaggcatccaacctagtgctgatttttttcttaatctgttttaattttattctcaaccacttcttcacatctacttcacatattttctaattcatcgtagtctgaaatttgatctggatcttcctgggaacactttgacccttccctccttcttccttttgttttaacattgtatatttataaatggatagactataaaataaagtcaggccaggtgcggtggctcatgcctgtaatcccagcactttgggaggctgaggcgggtggatcacctgaggtcaagagttcgcgaccagcctggccaacatggtgaaaccctgtctgtactaaaaatacaaaaattagctgggtgtggtggcgggcgcctgtagtcccagctactcgggagggaggctgaggcaggagaatcgcttgaacctgggaggtggagtttgcagtgagccaagatcgcaccattgcactccagcctgggcaacaaagagcgaaactccgtctcaaaaaaaaaaagaaaagaaagaaagtcaataggaatgtgtgcatattgcatacatgtttttaccattcatgttaaactaaatgcttaaaataaggcaaaaaaataaaaagtaaaatgttgtgatttgaggcgaaccagtaagaaaatgtgttggcagaattccactaaaggtgttggaaggaatgccacgcctccaggaaatggaacagaaaaatctctagtttcatatgtctgacttatagcactatttgtctctcatattaatgattaaccaaagttgtttttttgttttgttttgttttcagatggagtctagctctgttgtccaggctggagtgcagtggtgcaatctcggctcactgcaacctccatctcccagattcaagtgattttcctgcctcagcctcctgagtagctgggattacaggcatgcgccaacatgcccaactgatttttgtatttttagtagagactatgtttcgccgtgttggccaggctggtttcaaactcctgacctcaggtgatccgcccaccttggcctcccaaagtgctgggattacagggagtgagccaccatgcccggtctcaaagttgttgttctttattgttttcaaatttttcttccctatttctagcactaacattatttccatcttctcttccttttcaatatgcaggtatgaaattaagcatgacccaaatattcatgatgcaggagaaatcaattaatgttcctaatcaaactcatccgaagaagcctaacaccactgcttacaatctccctttgcttccactcttcatctcactgcccttgcccctcagcttttaggtctttacttgaatgtctaatgttaaaagaaaaatgggtgcatttgcctgctctttgatcactcattctgggcccagtgatataagaatgaacaagagcacttcaaaaaaccagacaattgttgtcaaaaagcaattcaaggggtctgggtatgaagctgttagatgcattaggtatattgttgagcagatgtaatggcaaggaaattaaattaaagattccctgtgatagaggataaaggaaagtttttaaaaatataagtcaccgtggccttaaactatatgtcttattttcacactctattaaagagcatatttagtatgaaaatcaagatacaaccatagtgttggctttgaattttattaatgccaccttaaaaactgatgttaagctctcctggctagctttagtctatatacttaacaaaagattcagagaactggttttccaatatcattttatgtgcaaagttctgtgttcagtaagtggctgtaaacttagctctttacactacatgacgaattttcaaaaccatccatagattttccttagcaacctgtgttgtgagtgttcttgagctgtatctacataagtcatggcctttctcatcatctggcactgtggactcagggatacagcagacacagctatcttttctggactcaaggttagtaaacatttgagaaaggaaattcaataacctgctttcactgcacaatttctttgccagtgcttacctttatttttgaggatcatactcctagccagcttgcctagagctagcttgtataaacactgcagaatgtctacaagtatcttggccaaggttgggaggaggggggtcccatgagacatggcttctccttttctgaatcacaaatctgcagacacagtgactttagagtgagcacgctggtttttcaaccataacctaattgctgcatatttcttgttggaactaaatcaggaaacactcagtactaatgaatttacatttggcagtggacgagtgctacaaatgtccagctacttatggctaataattttaaaaataaatcaaatgctttgaatttaactttactctccgacctcatttctccagtattgctgaaggtgagagggggtggggtaagatattagacataaatggaattcccatttataatgtactctttaggtaccattgaaaaattgtatatgtgttgtcagattacctgcttaaaaatagcaaattgcttttctgcctttatactggtcacagtttaactttcctagataactgaaagtcatttttttctgtgtgtcaattattgtatcatgctgaaatatagcactaacttgagggaccatgttggtgagatagggcttttgacctttagaaaatggtaccagaccactgtgcctttcatgttttcaggctatttatagcctttctcttattgttaaataatatcatttcttgttctcagattacctgtctaaagtctccccaccctcatccatcatgactattttattgcttaaaaaaattgagtggcctagaaaattagaacagaaaaatggtagaactgtaaaatactaataaatgggctctgagtggaagcctgtgtagctttctatgagtaaagttaaaaggttttataatatagttttgtgacatcgtttagtcttctaacaaagatgcatctttgttattctatcatcttggactgtgactgtcttcttagttctctcccatgctctgtagttgaaatgttagcacctcaatcatctctaaagtgggtttggtagtttctatggccacactttcacttacattgacttaagtgagctttttggttacaatttaaaagttattaagttatttcaattcatctttaaataatagcactacagggagtaccactgtttcaattctgaatctgagtatgctcttttgaaacaaagtaagacagacataactgagctttgtcattgtgccacactgcttttctttggtttttgttattctgaaatcactttattcatgttataagctactgataaaataggattatttttattgaaacaaaaggctgcctaaccaaaccaagatattcaaaagtgagaaagtctagattggatgaaaaaaatcaaataagtaaactataagcattttctgctcaaggaattttgataattgaatttatttaatatatatacatgagaaatttagatacttttttattagtgcaaatgaacaagatctatttctattaaaattatgttcttagttgttctctatcatgagccctttggaacagaaacagatataaaaatatgtaaatttgttataaaatctttaaaaaatcagagcatagactcttttaaatatagaattaatgttaaaaatgaagacaatgctgaaagcatatttactgcatagaaattaagatcacaaattccataaacatgaaataaatgaatcattccaaaattaggaacaaaattctccacagcattgtaattagctgacctaatatttgcacagggaaaaaaatttggtctcattttagccataagtatttgctgccttagcaactaaatccattcatttagtgattcaaggtttagctcaacttcttggaatgtgtaacatgtgattttgaaataaaatattaatgttattttattttcagaaaacctgaaaagaagtaaaacagaaaagcaatattatgcgtggagacttaagattccacccaagaaggactttatgagatactgacctgatcaatgtagataggatgatagtaaggtaacattcattttaggactttatctgcatttaatccacaatgtaaactgagctaaacataaaattaccattgtattactggtctaaggaaaaagcttcatacgttaattcttattgttgtttccaagtctttaaattattgacatattttttcaactaaaaaggaactttttttttgtattgagatatattttaaaccaagctggactcagattgcttttcaaaatgagacaagcaaatatatagtaacaggcagctaaagccttacctgttcaccacgaatggagcaagaatgggttaatgaacatattttgactccatggtatcagagaactgtgcagctgaatttctttaagtctgaaataatttgaatttgtccattgttctggtattatgtagccacagttccaaacagtcaacatactaaaaaattatgggacattgagtcataaactttgtggaactgggaaaaagacggttgccatagattattcaactttgaaccgtatatcatgaggtaattttatagaaaattattatgatcaataatttctgtcacattcaatttaactactagttttagaaacataaattttaagagaacataaaataaatgagaatatgtccatttctgtaacataggaaatttcagctacataatgtctgatgattctttagagtgctaatgcatctatcctcctgtgtttttattactttaaagtactgaagaatgcttggaaatttgcaacagcttgtttcaaagattacttaggggtcagaatttattatttctaaaaattgtaacttcctcagtatttcaatgtaatttacagcactgatcctagtcttacagaatttaataaagtatgttgtgctcttgaactatatttgaaggataaagccaaagattttcttttgaagttcttaaagtgttttcccatcattcagattgcttttctatttctgttatgcagtttttactctactttcaggagaatctcctatcagaataaaaccaaattcttctagtcagtgcaaatctagaaagcttcctcttctgggcttatgttgccataaagagaatccagtagaattgtcacctacaccttaactgcacccctataataggcatgtaacaaataattctgagagtcatattaatagcagggaaaccaagatgtctgccaaagttctcacaggaagctagtggtaaaagaaggaataaaagccagactttcagggcactagctaggcattctgtgtggtcttccacactgcttctcctttgaaatttttcaattcaaaagccaaaataccatagctaaaatgccaccaaggacgttggcagtacatacccacatatgatcaattttcttggtctttcttctgacactatccacacaactattgtcttagagggcaagatgaatattatgaggatataatgaagtcaaactcctaagaatcccaaattttgtttctcagtctgtgttctcctaaatgatacataccatggccatcatccaggaattctgtgatggtggctgaagtgcatttggaccagggcttagatgcatcaatgctggtaaggatggaagacattaagcgcttatcttctgtggaaccaaaggtctcttcacagaatttggaatcgtcatgggagaggccaagtaaatgtcctaagggagacaacagaggaagtacaaataatccgtgattgtgtatttctatctttccatgacaattatgctagggcttgatttttttcccctaattgtagatgagttcactttaactgctttctcacccagagactggacctccagggaaataaaagttgcatggagttagtgtagcagttgcttttggtgaacatttcgatggaaactgaaaaactaaagagtagatgttcccataattcatctggatcacatatgcttaatgtcatgtggaaacaaagccttatttagaatctagagtttgcgagacaattgtgggattatgtcatagccctcaccacgtatcattttgattgtctaattttctgccttctctgatcaagccccatgagatcaaagtgcatttgctcccatatactgttgaaacctctgtattgaacttagtgctgtgcaagttgcaaacacttagtagatggtttttgaatgtcagtgacttattttcttagtcaagtaaataggtggctaataaaagggaggactaggggagacaaagaaagagaagtgaaatgaggaagtttccggtttcttgcaaaactaagcttgcttcatccgttcatttcttttggtgatttagtgagttatgaatgtttactattgtcacaaacatatagctcattttgaaaacatacccatttacattttaaaatgtcaaaataccaataatatggagtttgagagcttgaagaaaggacagcttggtttcccaagtgatagttgtgagtgttcaaaaccactcagccaggtgatatttgtgcttaagcctctcaaccaacaatgttctctgaagttccagtcaagctagatattatttcacagagcccataattgcattcttataatccaagtaaattgctttttattacataagatcaattttcatgcagtctaaagataaaatgatattccacaacaaatttacaatgctatttaaaacatctaggacagtagtttgagcaattacaaactctaaaaagtagacagcaaatcatcctagtggtgtttttaacaaagctttctagaatcatacacaaaccactaaaacaaatttaggaaacactgtagcaaactgatgactacattctccttgggatcttgaatgccaaacgcagaaaactttggccattctagcaaaagagtccagtgtgcaccaataaaacccaacagagatgaaatctttcactttatattccgactactttgggccaacttgttaaatcaccaacacctcataacaaaattgtccactgagcaactgactgctgttatggctgaaaataagtggctagggctcggtgaccttccaagcctccacatttttatgttatttatacagatatttacttcgacagcatttactaggcttacaagttttctctgggaagttctcccaccaccacttaacattttgtttggtcagtagcataagtgtgcattatagtctatatataaagtatgtcccaaataacttgcaaaggaaattagcaggggctcatctaatttttgagtggtttgttgagtttttcaagaaactcacagctcacagaaaaaaaaaaaaaacaatctttcattcatgtactattagaaatgacttaaagttacttagtacatgaaatacttgctgatatcgcactctacacttcccgaaattttccaagatagaagatttatcagttaacactgagggatatggtggaaatttcactcttgagttttttcctctggcatagaagaaaagtgtccccaagtgacctctgcaacataatatttatttgaatccaggtttttacttaaaaaatgtgatgtatacattctacttcataggatatttatatttatttaatgaagtaatggccttttcctccaaatctatataaatacatagcactttccatatgcctttttattattgtatcaagagattttcacttcatttggagggtagattttagaattctgatttaaaatataggacacatggcagacacgaaattcactttgagggacctgagaaagtaccttcattctctctttcagagaggtgaagcatgtaattttaaaggtttcaattatgtaagcaagtcaatttaattttgaaatatttcagcatcatttatgaatcttttggaatactagttaatataacattatgacttctatgctccccaaatttgctcattttccactgaaacttaattgccactgaagatgcatagaggaaattgcactgcgaaagactgcctttcaagcatgaacaaatctttgcttcacctcagcaaggggatgtgacttttgtaagatctccaaaagtcaggcagaaacagactgcttagagtcaactgaaagagatcgactcttttgagggcgaatgaacactctgtgctccatgaagaaagcctgtcagctctctgggagaggcatgctctctcaagggcagcgagagtcctgggcaatgtgaagaacacttaagcacccaaagtaacaggcagccagttccagagtagctggaaccagggcatggcgagagaaccgcgtgacttcccttcaggagctggacaggatatgaaagggaagatcaatgtgagggatgtttggatgctcttcaggaaagacgtgacacacattctaaaggctgcaaacagcaaaaggagtggtattttgtaattcgagcccccagtcaattatgctaagacatttactcttagttgaaatcggccttgaaatagcaaaagtatacaaaagtataagcaattttaaaggagtgctcacggtaaagacggcacgctatgataccaaaagctaactaccagagaaaatccagaatccggggaatttaaaatacagtgtcacagctgacaactgtcttttaagtagggattgtgaaggggaattggaaaagctaatagctttgaagacatctgccttttcagggagagtttgttcataaatcattcacagagatgtttaaaatgaatggtgtggtttggagattaagcatttcttggacaagcagaccccaggagcattagcagcagataggattagatatccctgtctcagagagtaaaacagcacatgaagaatataaaagagtgtggagaaaatgtgtacaatgccaaaagtaatttgttgtttacatcaaattgtattacatgatgagtttttagagcaatacagagcaacagagttagttgagggtgaggttttagaggaggcagggggatggaatcgagaaatccacatagaatggcaatccttacccttggaaaaagagaaagagttcttttttggagagtcagagtgttgcaagagaagggtggggaggactgaaagccattttgacagagatctgaggaagctccctcactaaaataggacgtgaaactcctagtgagagaaaaggcagaggtgggtttcgaggtaactatctgctgtcaggatttaaagcagaggtagtgaagtcttgctttagggaagaattagtgtttgtgtttaggaccatttataatcagcagacatgcaaaagatcgaaaagcagtttgcttgagcaattttgtttacaatactctttctcagctatctttaattcttgatgatgtaattggaagcttttcacctaaaaccctgaggcaactaaggaccaaacacacttgtgtaatagatgcacttgttaatgacctctgtatttatatgctaaatagggttttaactggggaggggagatagaagccagagtgaaattcagagaataatgcaactgtctaatccacgagtattttccaagcggtgcctacctcagaactatatttattttctttttttctttttctttttctttttttttttgagatggagtttctctcttgtcgtccaggctggagtgcaaaggcaagatctctgctcactgcaatctccacctcccgggttcaagtgattctcctgcctcagccttctgagtaactggcagtacaggcgcacaccaccattcctggctagttttttgtattttcagtagagacagggtttcaccatgttggccggggtggtctcgaactcctgacctcagttgatccacctgtcttggcctcccaaagtgctgggattacaggtgtgaaccactgcgcccgatcagaactgtatttcgctgtttgaaataattagtaaaagctaaggtgtaaattgtgttagatgatgttgacctattcttaattgatgttaaatcatacaacagtcatgctgagtgtctgtcagcaagtaacatcagaaaggagtttatttgaattaatctaagaaattaaatgtaatgataaattatgtcagagtaaagtctataggactgagagtttgagttacattgttagctcagaaatagcaaacaaatcgtcacctgataacttttctggtatgaaaattctctttttcaattggcaaaggggtgacattttataaaataaatgttatctttgatattcccaatacagattttaagaacaccttgcttcattaaattcacaagagaatctggtgttagaaaatctgtgataatgtgtagccagatgaagacacatcactttaaaggaaactgttggttcagcttcttattcaacccaggcattactgtacaaccagggctgacttataacattaacctcaggaaggaaattggttgtttttctaaactttggtctgcaaattaaacagaatttcaagctcttgtctcctgatcccaaactgaccaatggtcaaggggacacagtaccacatcctaaaaaaatgtcacaagaagctctgtaatgtgtttactcgggaaagcactgctcagatgaagcatctgtttcttaatgaggtcatgtttttattttacctaattttccagctgggattatggaggtgcacggtcttgccaggggttgaaaagtgagtcaactgctcacatggaatcagaatctagaatccttgaagaagggaaccatgagctccagtcattggatcatgcatgcttattcaaacacgaatctttacatagatgtgataaaactcttataactcccatttgaaagcattaaacatgaatggtaaatgtggtatcaattatgtaatttggaaggaagaaactctaactttttcaccttataactagctgtgtcaatatccttttgaatccatttcagaattatagcctttaaagtaaaaactgtctaaaaaaacattctagaagcatataaacatcttgagctctggagccagatggattgggttttaatctcactttagcagtatattagttgttgaccttagacgggtttagaaagtaccctgtgtgttagcttcattctctctcttgggtgacccactaatggtacttacctcatggcattttgtaagaattaaatgatataaaacatgcaaagtgattagaatatgtgcttgacatatatcaaaggaccagtgattgttagctaactttattgtcctcattgatattctgggattgttatatacttttacttatgagtattctagtaatcagtgatatatatatatatatatcacacatatatccatatatatatatcacacatatatatatatatggagagagagagagagagagagagagtcttgctgtatcacccaggctggtgtgcagtcatgctatcaaagcccactgaagcctccatctcttgggttcaaatgatcctcataccttctgactagctgggactacaggtgcacaccaccacccttggctaatttatttatttattacttatttatttatttttttactttttgtagagacagggtctcactatgatgccagggcttgtctcaaactgttgggattacaagcatgagccaccacaccagccaacaagctttgatattactagacactctttatgtgggagggaagaggaaacttcctaaacataaaagaaaaaaaatcactcagcaagtgtgtgttagagttactttttatgccaccttcaatttgctggtttccacacatgtgctagataatctataggtttctccctagagaaacatgaattgggattaagtttttaaaaactgacaatagacacaaaatctctcaatattcctcaacatatagcaaaaacttattcccacattttatttgggggccaagaaagacatagtgtggctttcctccaaactgcttgttgattaaagcaatgggtttgcgggaaaatatcaagtttaatcctagtttccttcgaactttacatcttacaacaagcctggacatctgattctgtgtatttggatttggtctgtggtgtttcaagaacctctgcagcttttcaaaatatggccgtgtttaatctaatcatctacagaagcagagtcacacacagatcagcacaaccagggaacaccttttaaccacaccaaaacacaggcggctttgctgttgtgtctcaaccacttcctaagtctcagctgaatatttggtcttgacttgttaagttgcctgagtttagcttaggaagcacactggagtctttcacagtagagagattcacttagtgcattttataattaaccactataaagcaaagcttcggcatgtttgcaaattatggatttcatttgtctaaataaaatcagattgttcctcctagtgtattagaagctggcccaacatcaataaaattattgtttttaaggaccatatgtgcagcaggtgaaatctttattattacaagtcaataataaaagtttgacaagttaaaatataaactcaaaatgtaaacttacactaacttgaaaactttctgcagttcacatttggattgtaaagtggctgtaaacacattcctgcctccactcgaggaacatggatggggactgtgtttttgatagtttgaagtgactttctgaaatgtcttaacaatttagccaacatttacatgcatataacacaagaaggaaagcactttttgactgcctatccagaatcaatgtcaatcaatatccatcttccagaagtctgtattggcatcagttgattagttaccttcaaaatctagcagcttttttgaaagaattagcagaaaaaaagaagtgttctagtttcaaatggtatatgaaaagagtaagttttcataattgttcatttttaacctgtgtcattttgacttcaaataatttaatgccgtgggtagaaatggtgtcagatagagactacagctctgcctctatttaccttatgagttaattatcaaggtaagatttttttttaggtggggggctcactctgtcacccaggctggagtgcagtggtgtaatcatagctcattttatcctctgtctcctgggctcaagcagtcctcccacctcagccttctgagtagctgggactacaggcatgcaccaccatgcccagctattttttctttttaattttttgtagagacagggtctccctatgttgcccaggctgttaatgaactaaaaagaaaattttgattcagtttattcatgcacaaaatagatatgactttctattttaaaccactgtgaagagaaagaggaaacagttgtgcgtttccacgagaacctgtaagtaggttaatggaagagttattcttgctcaaatatatccttttactgcttatagaagaaataaagtagaaaaattatgggaacagcctgggaatctctcctagcttgtgttttgagcacagtaacacattcacactgtttgcataaaggaaattacacattttggaatgaggctagagtaaatttaaaacactggaaaactgagcattcaaaacgtcattttcatcgccatactttgaccatatacacatcttccaaatctagaaagtcacaaatgtctagtaaaaaggaagggggatggtgaaaccccatctctactaaaaatacaaaaatcagccaggtgtggtggttggtgcctgtaatcccagctgcttggggggctgaggcaggagaatctcttgaacctgggaggcagaggttgcagtgagctgagcctgcgccattgcactccagcctgggcaacaagagtgaccctccatctcaaaaaaaaaaaaaaaaaaaaaaaaaaaaaaaaaaaaaaaaaaaattaggaagagagaagattgcaggaattgagaattagaatcgagagcatggttagctcagactgagagcttcacacagcaatccaaaaaatacagcacgggaaacaaaccagcaagctgcattatccaagatcacactggctggaggggcaagactctgtaataatacacagatgatcaggaaatcttttgtcaggctatctttcctaaacgttgaaggcttattttttataacacatgttcataatatttaggcaaaaagtgaaattaaagaataataaagagattagaaaataaactgaatgagaaccagattcttttatgaaagcagaattgaatccatattcccccacttccagaccttaaatagctcagattagttcatatgtaatacaaaagggaagttaaatagagagtgtttgattgggcaatgaattacagggacttctaaagaaataaacaaagatgatccaaccaaaaatttaagtgcacagaagggcataatcatatatcaaagatttaggttttagttttcatacagaagcccacctttctcctacgttgtttccttgtataactatgtctaatattcttgtactattgagaaaagttcttactgtgtgtgtacacacacatgtatatatttagttttaatataacgtttgtgcttatcagcatctggcttcctgcctctcagactgctgcatcagccttgtaacccaagattgccttaggaattcaggagagctgggaaaggtgaccctgcagggctcttcaatcctccctagttaacttgaggtcaaagcatccctgaagaagctgcacttattgccacagtgtttgtcttacagggaaatctcccagatgcagtcaatgtgtgaaaaccaatcactagaaaggaaagaaactgcccttcctttaaggaatgtggaatctttccttttgaagatcaagatttggagcccataatcctgtggatggatgacgccaacattcagctctgctgcttattccccataatttctccgcttgacctgtgacgaatcagcttctgcctttccagggacttagaacctttcttatgggactcctctcactctgaatgatggtgattaattaccagtgtactttaaaagtctcctctatttaattacatcctcctgagtatttggactaattcctcttagtttccggtgcagatcggaatgttgccttgagcaagtctcatgtttctttctcccgcttacgcagtcaagcacatacatagatacgtaataaatattgattaaggttctgtattaggctgtgtttttatcagtaaggattaataggcataaatgagagacatgatccctaccctggagcctaaatggcatgtgttataaagacgctttcaggctgaccagttcttctagtgcagctgagaagacagccatgcctcctcattagcccactttatagggaagaaatggagactcaaagtatctaaatcacttgtctgagataaaacagagaacccagagacagagctgggactccactcagatctttgactactgaagccaaagacgcctaatcaataaaacactgaattattctcagtgatgctattggataattatttacgtttaggttttatatttgtgtttttctgcttaggaggtaagaaacgtgtcaggaacattaatgccatacttaagaactgacatttaactactgaattctgttttactgcggcaatattgtgaattatgcaattacactgtaccttggattagaagttatttaactccccaaagaaaacatagcagttagaaatggatgctttgtgaaaatattctctgcctattaggaatgtaaaaaagtagttttaattcccatttaaaagttataattttaaccttaaaaatcaaaatctgtttaaatcaaaatcttttttgctatagatggcaaaaggtaccataattatcaaaccatgctttgctcccaaaaatgtgatgctgagttgatacatacatttcaaaagcaaatgaactatttagctaaaaagcaaaacataagtacatgtggatataaataacatctactatctaaactctacccaatatattccccaaaataattccctgaaataggcactattatccctatgtttcagatatgaaaactggagctcagagagtttaaataattagaccagtgtgacataggtataaagtaatttagcaaaaattgggctcatttaggactagatgttggaattagacagaaaaaagttagacacaaaaaattgtgtctaattccaacatctagtcctaaatgtactaagccaatttctcatacacctagtaatctaggtcaataattaggaagcacatattctttattttggaaatattttttagcaatcaactcagtcctctatttatagatgtaggatttagatgtgtttcttacaacaaacaaattaggtaagtgacattttaaagcaaaccctgttgagtgtcaggcttggcttcctttccttgctattaagaacaagacagaaatatttaccataagccattgatgacctttgacaggagcctacaattatcactgacaatgaaataaaacatgttaaatttctgtgcaaactgattagccctggatgagccagtactgtctccagtaacttctaagaaggacatctctgcataccaaagttgcctgtgacaaatttcatccaggggtcatttacggatgcttaaaaagatagtaagaaggcagtagcagtagcaaatttctcttgaacttttaaatgacactgtcagaagaaaacatccaccgtgttgctgactttgccttccctgtcgctcgtattagttaaccttaaaagtgcagatataaacaaatttaattcccagtggtacatctgaaccaggagaaatctggaattaattgctaagtattttggttcctgttgcagctgttacaagtgtttgatttggtgagggaaaagaaaaggcgctgcataccgatttcgtgagccacagtgaaggctgcgtggaggccatcgtcttcaatcacagcacagctgcgctctggagaacatatggtcccaacgtctgccattcccagggtgtcacatgaatgatgcccacataaatcctgcccaggagaaagaaagaaatcattaaaatcaatttacatccagaaggagccgccacatagagccacttgcttaccccaaatggcaacagggatatgtttatggtatcacctgttcctctctggaaacgttccaaaggcaaactcaaggcagagactcttctgaactgctctggggcccagaaacacagaaggataatggaactcaattacatttaaaaagatgtcttaggattgtaacttgtctattacaatagcacccgcagctttaacaaagccgtaatgcagatacgtctctgatcaccttcccatatggtcatgcttaggaaagtcctaaaattctgatggaaattcatgctaaatttatcaaaatctggccttataatttgttttctattacaggggcaaactgcagccagacgtctgcagcagagtataaatttattagaaatttggatagaaaactaaattttaattcataatttgaggaaaggtcatcttttactccccaaatgagctgtaatttcataggttgtgtcttctgaaatctgtaccttcttactcataacatttaatgtagcatttctcaacctgaccaatctgcagaaaatatatgtcatatattaattgtgtatacatgaatatatgcatttttctggtaaaaagtcatagtttttcatagatgtcatgtaatcttttaagagattctcaaataggaacatgattccaccccaataatggtgaaaaatgatcaatttagatgaaagggacctcaacaagcctcttgagatatgaaacataaagagaaaatataagccgcaactttttgacatgacagattcataatgataaactttccctttaaatgctatttgagtattaatggacattagcatttcttgtgcttgaccacaattttccatgaaaatttactaacaatgtgctcatttatattcccaaagagcaagatcgtgtttctagtaagccataagttaggaactctaaaaggaaaagttttaaaaatatactaattattgtaaagacaactgtttattggttaaaataataaatgtttctattatacaacaatcatttttgtatgcccaacttccatattctccagcttatatagtaggaactcagcaaacatttgtttcattgagttgtgacctacagtcagatacattatagtgctcccacatctttaatatgctgtatgccagcaggacctcagcaggctccagacaaccagtacaaggcagtgtgactacataaccagtgctacatactcaatggcaacatactcttctaaccctttgctattttgctgcataaaaatcctaccaaggtgaagagtatttagaaactcagctgtattctcttctcttaacttcattctcaggtccttattgtgttctgtttattatgagttcccagctgagataagttacagtgtggccaccaagttactgtagctttagacactggaaatctcagccaaatagccttggttaatcatgtcacaaaaccaacagccttccaaagtttcctgtatatcctcccatgtcatcccatgggatgccaaattacagctgttgagtacaaatcagtagtttttcaaattgaaattggaacacacttttgcataataatcagtctttgagataataatgtagcacaatacatttttaagcccctcccccacaatcatttcactatctctaggaccaaaaacctaggtcatgccttaagggagctgctagacactctaggttatatctgcacacattttttttaaaacaagatttatgtttatatcacaatttggggtatttatctttaaataataaaatccaagaattacattttcccttcttactctataaataagctaagatgaagagccacagcaaagggaaatgaccctcctcttctcgatagagattaaactagattcttaatatctctctgtttactgctaatcaattgctcattagaggccatcaaccctccttgtcatccttgaattggattaaatgcatttggccttttgccacggaaatgtgacaaaattatgaacagaagcacttgttatttttttaaccacactgattaaactccttgactactcagccacactatatatttctgtagctataattatgtaaactggcaacctttccatttcactcacacaatttcaaatcttggcaaacagttacagtttcagcctcaaggcttataatgaacatctgaatttctttgtgaacaatgttcatttcaatgaattaaaactaatgtgcgtcaaattgttaagaatacagcatctcgcattcatgtctactttctgttgatgatttctaacaacatttataggtgtaaaccttatttgaagtttatagaatactttcttaaattcttaaattctgagcaggagtaaagatattattggggcaatagtatatgtgtatatgtgtatacatatatacacatttgctattatatatgtgtatgtatacacacacatatatgtgatacacggatatgtgtgtgtgtctatagatagatggatagatgatagatagatagatagatagatagatagatataatctagacctggaagcaggagatactggagagatgtgaatcacatacaataccatgtaagaggtaaacgaattaaaagttctgacaaaagcttatctgcttgttcagtgtagatctgaaggtaagtgattatctttgtcatatcaaataaggcttgttttatgcaagatcaatatcttatcactactgtgtggacagtaatgcagtggaagatttagtaaaatatgaaggttgcaaaggttgcagagatttatctagtggttttgtggtatggtgttggccaggatacaagactgagacattgtatctaactcagaagtgtattcatggtggtctgcaccaccagcagagattcgataggaaggtcattgacactgtgaccattcaccaggtatgaccttttaggagactataaatatggccaagcttgtgatttatcacagaattttgaagccgtaataatacccaagatctactgggcacttcttggggatgggatgggggacagggagccagtaaaggatgctgccttgagaagcagatgctcagaagatagtgtgaactttgaaaatcccagtgggcagtactgggtggtgaaaatgaaccagtcagacccaaatgtcctaaggtggacaaatcacaggaatcataggatttcttgtcttgactgagagattgttttcacatgcagtgcaaatacgctgagggagggagccagaggcaacacaaatgctgacacaggtagataccatcacagctgcagccacagcagctgaaattaaggaagaacaccttatatcagagttaaataatagcaacttctgtttctatagatcttaccccttggtaagggcaagcatggagctcaagggaagagcacatacacacacacacacaaacgcatgcatatttgttctgtggatctgattcttgattcttgaggagtcctttgcctttctggctacctatccagcagtccccaataataggggttttaattttagatttcagcagagactacattaattggaactgttatgccaacctttacgatgacccattttatacaatctctatccttgtctcttgatacacctaagggataccaaacacacagagcccagatggattagggtcccagagatccagacgtgtttattcctaaaacaattattgtgtgcctacaatctgccagacactgtggaagtgctgacactgtggtaaatagatgaaataagatctgatcctgagctttagggaacatcaggctctaaggagcaaaacagatatgtcaagaacaaagcaaactgtgacttccattatgaacagattgttcagggagaacagaagaggcattgatgaattctccttgagggaatccataaaggtgtctccacggaagtgagtggatctgatagcctgggaggaaggatactctggcaaggaaggactagtggaaacataatggaatgggaaaaggcagagtcttttgggaatgacaagaagtttgttttggctggaacacaggatctgttgagcagagggctagcagggaagctggaaagagagtctgggcccagagttccaagtcaggaagctttctctgacaaatgtgaggtaagaaggggaagaagagatggagcaagttggagacagggagcaggggagtagatgcttgacggagtcattctggtaaagagaaatggaagctggttagagagtgaatggaaggtagattgctttttaattcaatgctgttagtgagaagcactgtgtaaatcatttacatgctttgagacaaagttccctcatcattaacatcaggagtttggtccaggtcatctctagggtttgttccagctacacatgtcctgatattaactaaaagcattccaatttataaagaaattaaagctcaggggcattaaatgctccaaatctcaagtttgtccatactgaagctgaaattcaaacctgtatctaaacactcagaatcctgaacttacttcaccatggttttgttaagtcatcacatacgttattcttgacattaatcttatcttttgtattcataatctacacttgattaagcaaatttctttcttgcagcaaataaagaatatcctggttttctctctatgctgtgttggaaaaactagataatttagaggtatactaaatatatgaaatacactgtgaaagatattccagaaaacaagaaaatggaagcactggataagaaaactggtgacatcattaactcgcctccttctctcacctgtcacatctaattagccactgtaagtcactgtagttgtcctctatttctcatttttttctactattatttcctgcctgaattataacccgagacttctaactggtcccttttcctcctgtaacttccttatctatatgctcaagtcagtcaccttcttagagcacagatcttattagattcctccagtccttcatgtcagccttagcctggcattcaaaacctggcacactacagcctcagtctttctgtctgcctccactgtaccttcctgctccattctgtccactattttgtgcatatctcatgaatattttggcctctgaagctcagcccaagacattccttctgctacaaagaatttttactcacatccacctcttcctaacatttcttgacccaatctatgcctctcaattcctaatgccactgctttagtttagaccaccttgagcctcctcttgaagatttctgaaacagcctgctcacccaggatccagtccactacttagaccagaaggttcatttcagaacacacctctgatcattgctgtcttcctactaatgttcttttcaatgattgccattgcacttaatttacaattaaaacttgtcagcatggtggagtagactgaattgtgtcctctccaaactcatctatttggagatagggcctacaaggaggtaaatgaggttaaatgaggtcatgaggacaggactctaatcagatagggttagtgtccttagaagaagtgatacccaagagtgttcactctgtttctacttgcaggcagtgggaaggctttgtgagtacacagtgagagggtggccatttataggacaggaagagagccctcactagaaatcaaattggctggagccttggtcttggactttctggactccagaactgtgagaagacatacttcggtggttaaatccacccattgtacaatattctgttacggtggcctgagcagactagcagacatagtgtatagttttgtttttccatagttgggttgttattatcttctccaaactaatctattaccatttcccattgaacatgatggtttgctgatgtctgcaatgcctatctcctccttacgtatctggctaactcccactctttcttcaaaattgaactcagatggagtgagcaatcttctaatgcacttccataataccttacaaatacatctactgtaagagccatcatgctgtgcagcaatgaccatttccctgtctgtttccaggaatagattcttaagaaaggggctactttttaaatctctgaatccctccttgcctacgaggagcatattaaaggtttgaataaattagtgataatgcttttagtttagagagcactagacaggactgtcttctctgtctgccatttgttagctgttagtctaagaagtttatctttgtttctcttcacatgaattctgtcaagataattacacaatggttacagattgttgaaatgattaattgtaaaatagtttgtggccatggatagtacataagaaatgctcaatagcagctggctgaatctaaatccaatctatccatcctttgaggaccaattcaattctacatttgcaatgagacctacagaaaggtccataggcagaattaactgttaccttccttttcctttcacagactttgtttatatctcagtatgggatttatcagagttttcctaacagtagtgtgatttccacgtgtatctgtttccactctgctggggatacgcctagtgggcagggagcaggtatttctacctcgctgccttaaactgcctacatgagtctcacacataggaggtgcatgtaggcagatactgcacagattttagatttttcataatatccctcacagtttattgtaaaaatgttaattagagctgcttagtctgctaccagtctccccacttctgagttatttatccttttattgattaggattgacctataggctctgattccttgacaagggttcacttttgactttaaatgagatttcagctcaaatatgtgactgaattagtccaggcagcaagccaataagaaaaagcccatccctctccctcttccaaacttctggtcttcctctactgccccctgttgtcagaatcaagccaggagccacgtggtaaaggagaaatgccgtgtggggagacccggtcccagcaatctaaggcagaatgtacagagttttagctgagacagtgatctatcaactggcatattgatagttaatgaaagggaattatctttttatattgcacaatctcttagttggttcgattttaattcagtgtttcaatctatgaaagagtaaggtttttgctgctttcatgaaggggtggagggatattaaacaatttcctattttgttatcaagcaggtaggcttttgtttctaaagagcaaatggtctaaaaaaaaacgactgtaagagtttgtctttgaagaaattatcttgaaataaaagaggacgtccagaacaaggaaaggattctggaaagcaaagctaaatcctggggagattggatttctactgtttgatggcagaagtggtgtgaattccagcattagtgccatttcagaatgaaaacagcttttatgccaggaaattgactggtgctaactctctctaattagaatagtactggagtgctgggtacagtcctgacagtgaagtgtgatcgtttgataaatgagttactagctctattctgctgacttccagatgcaactttcaaggtggcctcagctagtaaacagaggtagaaaacatatcctcgtacattcgcttcatgcctaaaaaacaagcaatttaggagaagacatctggacctaaatttgagcaggactcagagcccatcaaaacatggatttcatagcttggcgtctggctgctaagcaacgcacttcttacattcaaaacagagttgtaaaagtagaatcttggtgccaactctgggtatttctcattgaaaaggaaatagctctgaaagcttttctttgggccttaagataatctgattttcatgagatggaagacctcagatcatctctcctccagacttctttttttttttcatgctctgaagtattaggcaaagttcactttgcattgtgaaatactctcaaatgaatgctgcataaatgccttgaaatttttttcaaccccctaattagtaacactcttttaaattgggcgcatctattgaaaatacacatgcatttcaaatatttgcttcttgtgaagttagatgtgtatactacagggccaaccacaaatgaaatttgttttcctaaaagtatgcttctgcttggcaaggagaccagagagggcccatgtgaaatattttccatgtgtagactagtttgaaaaatgcatgtccttataatactgacaaaaattaagatggaccattaatttatttgtcccttgctttgtatctatttaaaatatgctgttaagtttcagactttggaaaaatagggacagttaactatccaaacaaaaaacaaattcggaaaaagtaatcgacaaatcattgagaatcactgagtagtttcctgttttctgggaaacaattaggaatgttatggggcaggaggtaggaagtaacagaccttctattaatttttatttattttaaaattatgaaatgtggatttgtgtttaaaaatgaaagtgaactactaaaatgacccactccttggcgcagtatgcttacaaaagtatttcttcctcttcctttagagaacctccttccataaactctccaaagcctccttcttggcatcctcttgtgatgtagcagagcaaggaaccccagacacggaaagttgcttaccaaaaaaaaaaaaaaaaaaaaaaaaaaaaaaaaaaaaaaaaaaaaaagagcttggaaacctaacaagaaatggatagttttacagaacttcattttgcagagaaggctacaaatgaatgttctaccgcttcaaagactaatgttgtgcagaggaattaaaggatggcttccagaaaatcacttaatgaggaaaaaaatgttttccattgtgcacagcactgcgcgctgcttggctctccctaaactgccgccctccagcatctttgtttacatgtggtttacattaatgtccaccctatgaaccacaagtgtttctctactccaaatttatcaacacttttccttcataccaggggtgccttagtaaaaatagaagaattaggtagcgaagctgtgtgattctaaagtctgcaatccatcatttaatttcctatccttgttctgtttgcttcatttcataccatgattttacataatacttcaaagtttgtaatccttaatctattctggatgggtctcaaatacttaaagaatgagctttagaagtcaattcttaccaggcatttaagaggcacaacttaaaactgccaatcagagtcgagttgtgacaactgaggcttagaactatgcgcaagccaggccccaaaccaacccagactttttgtgtaaatgtcacactaacgtagtggtcaaatactgtgtaaatagatactgcgttcctccctgagcctctgagccttaaagatccatttctttgcttccccataaccatctttcttaaaagggggaaatgctgggaaaacatttcttccttctgtcttgactcttcgcccagatcttctgcactggggcttcggaaacatattcatccaaaacccaaacacgcaaacgggatgtgaccctccctaggcggcggagttggcctgggcagtgcttgcgacgcactggtcgactaagcaaaggagttgttaaggaacctcacaagtttgtcctctcatctgattgggtctctgtaccctgctggcccgcccacattccttccttcccaggaactgagattccaaggtggacatgtaagaactccattaggaatccaacctggaaaaagagtccttgagaaagttttctcatcctctgtgtaacagaagggattctagtaaaaaggtgtggacacttacaaaagaaggtcatcggataacagtgagtaccgtgagtgaaccatccagccctttccattaggtgggacaaggttatattttattttcactggaaagaagaagacccatgatcccaaaggcaactttgttttccttccttttccccatttaactgtatcatttccccaagcatccttgtgccttcttatgtttacgttcctatgccacaacacctcagactagatgacatgcagcactactgggtcttcatcatcacctaagcaagtcttggcatttaaggcaaaaatttctgcggggctaacgtgaatacaggagcagagttgaaggctggttggatttcctgcaagaagcagttaaacacatccacagctgcaggaggtttgagggagaagcaaagccaccagcaagattcccttctacctacctcctgatatcagcgctgggacccccgcatcccggctggacctacctcccgagtaaacaggatagctgcatcgtagtgctcctcatggtcatctcccagctggttgtgttggtgctgccacttgcaaaagttcttgagtgtggtggcagcgttcttgctcacttccaggctcttgtccttgtcgcctagcaccaccaccttcaccacggccaggcggatgtggttctcgatgctagcatggctgtacagcctattggcgatggaggccagggtcagcaggtaatgctgcaggccccggccatacaaccgcgccatggacgcgtcagccaccagaagcagctccacctggcgggcccgggagatggagcggcgccgccgccgccaccacgtctgcggtcctgagcccccagcgggcgagagagcggactggtccaagagctgcgaggccagtgctgcgcgtccgctcgggttgctgtgcgccggagcatgctcgtgggcctccggtgtggacgcgggggtttcgcagctggcgcgcggcggcagggcctcgaagctgaagccctcgcgggtgtagacgtgcaggatccgtgcggacccatccccgtacacgcgccccttttcttcctccgcccagggtccgcgcagcagtggctttagggtgtagcgcgcgtgcttgaccgcgaagaagccgtcgagacccccacagaggtcaaagacagccagagagcggggactaccgtccactgtgccccgatagaagcagtggctccggtggcgccagggcgcactcgtcccgcctcctgcgggcacgaagccagcaatgcccaccgaaccatctcgctccaggtccaagaggaacctccggccgcccgcgtagacgaggtagcccaccttgccgccgccggagtagagttggtcgatgttctgcaccagccccttgctcctgcgccgctgcgccagggggtgcgggtggccgggaggctcggctcgctcctgcacctcctccccctgccgccggcggggctgggcggctgctgcagcagtcggaggctgcccggctttatcctgggcaggtgtcgcggcggggccgaccgcggccaggggcaggcggaacgcgcacagcagcagggacgcccacccgagcagcatagtgcgctgcccgcggggaggggctgcgcgactgggactttatgggtatttgttatttgctatgaagttaacggggcgggggatggggacacacacacacttgcttgcaggattgagtcaagtgtcggagggaggggggcccggcagcagcgccagcctgtccgggctgcggtgccagcgtgcgaacttttctttgttgcttgggaaaatgtttggattcgtgctccagaaagaggtggggtggggggggggggaaagaaaagattaaaaaaaaaaagtcggatagtggagattcagcaaatacgggaaaaggaaaaaaacaaaaaccaaaaaaccaccaaatgcaggcacgatcgctgtttcaagaaaagtaaggaaaggtaccgcgcaccgggctggcaactggtgcgcgcagcctcccgcccccgcgctgcgctggacaagccggctgtggaggttccaagctccggggcccacttcctttcttattttgtgggtttccttggctctgctgggaccaggaggaagggaagaaagagaggggaaaaagccgtaaaaattaaaacaaaaatgcaggggggcagcctgaggcgagctggtgaagcggcgtgtctgtgtcccttcggctgcggtctcctcctgcccgccgtcatccccagtcggcagctgcgagcgccgagagcagcgcgagcgctgtgaagatgcgaggaggtggaacaatgaatttat

SEQ ID NO: 1087 - DNA, 28446 bp, Homo sapiens
atgcaataaacaagaaggagcagccaacaaaatctcttaaaatctcagaaatgttcaataaacatttgcagagcgagaaaataaataacatcgcaaaggagccagtggctcctcttttccccgcatgttccttgggtcaggggtgcatgtgtctcactagaagtcacatgtattaaaagcaggtgagttccagctctctacaaccccactggcccccacccaaatgctcccaacgggtccctgacaccctcgctggtagctcctgcctttgataagctcctctagcctcaactgcttcttgatcctggctcccttcccagacaggctgcccagaaccctggttcatctgctcactggagccgctttgccagccagccagagaccccctcccagccatggcctaaagagccaacagctgggaacttgggctcatccccagctgcgtctggtcggcttggcggccaactggaaaacccagggcctccatggcgctctggacagaggaggccccgatcccagccccggctgccagccaatgccagcctgtccacttgacagaaaaacacacgctggccgcctgccccagggtgtttccagaagagaaatttaatctaatttacatacttctaggtacatcgataaccaaaatgtggccactgaaaaaagttaaaaggtcaatcagctcctggcttctagctggcccaggattgcaaaataaaaagatccacgttccttattctctacacaaaacgcgtttttaaaaaagtgaaaggtctagggagctatacatagaaagcaacagtgaaaagggagagggagcaggagtgggggaggagagtcccaccccccaaccccaccctccagggccccagagcccctgaggctctttggggggccttgacatggcaggaggcagctgtcagctctgagctcttcccagctgggaaggcccctctcgggggcagccaacaaggatttccgtggcattgtgggctcagtggggggctcccaggccccagcaggccccacagagggagcgtggcttcccctgagcaagcaccgtggcatgatgtggtcgttcaacccaggaactgggggtccggggcaggtcccgggtctcacgaggtgcgtgttgtgtgtgttcgcatgtacatgtgtgtgagaggatattcatgggggagagagggaaccagaacaggggtctttggggtctttgcaaatggccacggatggcagacatcgccctgcctggctgctagacgggggagtgctgtcctcccctgtgaccagaccggctgccatcagagacctggctgctgcccctgctggaccaggtgggcatgggctgaaggaagacaccctgtggccccagagtcctcgggctgggggaagggcagctagctggctcccggcgccctggctgtagtgtgcccggcccccaaggggcgccggtttgaggttttggcttgctcctttggaaacggaaagaaagaggaagagggacaaggacacagaggaggaagaagaggagacagaggtggcacgagaggggatctggaatgcttttgtgttagggagcctctgccgccgctgtctgtgcctgcggggcctgggactcctcaggtggggggtccgctttggagaagttcatctccaggatgtgccgctgtaagtgccgcacccactcttcctggatggagagggggccctggaattccacctcacagaacctgcatgggggaacagagagagggagtggccagtgctgtgaggagaggcggaagcatagccttgccagcatccctgggcacacctgctgctactcagtgtggacagagccagcccaggaggcgggggaagagggacccagaagtcaggcgtttcccatggacagccacctccactcaccatggggtcatggcagggtctcacagagacccctgcctctgtgctcagaagtcactggtgccaggtaagggctactggcttccaggtacccctgccatctggcagatacatagaatctgagacagtagagggcacagagaagcaaatcctacccaacgcaccaagccccccacctcctcctgtcttcctggcacctaaaaaggcctcacagcacagaggcctggagcccaagctccatggctcaagacgtggctttgactctgacttctgacttggcctgtatggcctcaggcaagtcacctcacgtctcagagtcccagttcgctgctcttcaatgtacttgtggactttggtaagaattaactaagatctacttttttcttgagccagacactagttgagtgcttacttaccatgtgccaggcagttctgagtgctttataaatattaaattcacttactcctcgtaacaaatctgtaaggtaggtttgttatcaacccgcttttatgagtgaggaaattgaggtaaggagcaggtaagtccttccctgaggtcactaagctggtaagtggcagagttgggatttgaacccaggtctcgcaggctacaaagctcagggtgtcagcctttagcctgagccccaccacacccaagggcagccactgaggcgacacctcccagcttccaccaaaccctatcctgttccaaggctccgggtgaccaaggtccactcaggtggtctccctccctcccccaggggcagcctacctgcatttgagggtgtagatgttgcccacgaacttgacaagtgatgtctgggggggccggggcaccagggaggggactggccggactcggggtgggggttgccgcacctcctccagcttctgctgtaggtcattggtgtcctcgcctccccgggctgcggaggcatctggagggcgggcttgtcggcgttcaaattctaaggtggagagggggacgggagatgagtgggaggggtggatgctgcagagacttggaatacacaagagctgaggactgatgctacctggatgggtgggatgggggatggatgggtgaatgggtaagcaactggagaaaggacttaagggccacagcagagcgcctggggagtggctgggtgggcctgacaggtgcccgctgcgctcccgaccctcctccaccaagcactcactgttgatgttctgccgctggtgctcctcagccttcacggtgcctggcgggctggctgccagaggccgctcaccaccgtcggctgcccggccagcctcgggccctggctcccctccggcactgcggccgaccacggccaggcccccgggtgccagccccagggacggccgcttgtcactgtcacggccatggccggcactgcggaacttcttggtgaaggggcggccgccctggatgtagctgcggtaggcgcccaccttctggggccggtgtttgatccactcgctcagtgtctcgatgggcgagccattgacgcaccactcggtcacgccgaactgccgcaggtgtgcccgtgcgtggctggccagggccttgcggttttcaaagtaaaggccacacagctcgcagcaggcctcggtggctgcggggcggagggggtgctgctgagtcacagcccaaagggggcaggtgcacccagatggccctgcccaggccaggtgccaatcccgcctcccacacagacccagccatgggggccccacttggggtcagtgtgcacgcttgtggcattgcctggcctggcaggccctggcggtcgccctcccaggaccctgccgcccgctgcttacaggagtgggaggtcttctcatgaagggtctttgccttgaagggcagttcagtctggatgtaggtcttggccttgacctctgctgggaggaggcggtcctcctgcaggggccgcttggctgccactgagcccaggtagccagtggctgagggcttggccccagtgatgggcgtcaggctgagctcacgaggaacctgggccggccctgcacctggtttgcctggccggccagccaggggcgacagcggcagtggggactgcacgggcccaggggccacggtgggaggcccgtcctcagccagggcaggggccaggtctccagccggtggctccttcttgatgaggcacggcttggacttcttcttgaggatctctcgcagtgtgtcgatgggcgaaccattgacggaccactcggtcacacccatctgccgcaggtgtgagcgcgcgtgactcgacaggcccttgcggttctcgaagaactcgccgcagaactcacagcggatgtcgcgcaccggctctgcccgggacgctgcaggggatccagggtagggggaaggaggaggaggaggaggaggagggaggaggagggaggaggagggaggaggaggagggaggagggaggaggaggaggaggaggaggaggaggaggaggaggaggaggaggaggaggaggagaaggaggcggcggctgcgggcaggaagcctccaagctcaaagcccccgtatcagtgccagctgcctagctacccctgtccacaccacccaccagaccgcaacaacctgctccctcatctgggcttccagaggcccttttaacatctggctcttctgcttgttctgtcacttcaaattctagctggcttcaagatacctccctgtatgatcctgggcaagtcactttccctctctgagcctgtttcctccgctgcaaaatggagatgaaaacccctacctcccagtgttactttgggacggtctaaaatgggaacagctctcagcatggggcacagagctggtacacaacacacgtgagcgctaaggcacaagcctgggctgccctcacctgctcagcacacagtgggcatccaatcaacctgagcagaatgaacacagtgctggtgtgacaggcaagcgagcaagtgacattacaatgatggcatacagagttttctgtaaccaggtgctgtgctaagtgctttatcccacttaatcctcaagaaaaccagacagagttgggactatgctgatctccatcttccaaatgaggaaacttgcccaaggtcacataaagctagactgtggaggaacagagatcttaactcacacttgactcccaatgtcaagcacttaattaccaaaaatgtcagaaagacacagttcagacgttcactgccagtccctacgctcctgctgtagcagacatcactaatggatccccgcagtctttctccctaggagtctggctggcagccactaccaatcgattgaaatggcacaagagatggaatctttctgctgtcactgaatgacacaatcctgcttctcaaatgaataaaggacaattgagcagcagctcagttgcaggggtctgcatagcaggaatacacagctaaccctgtgtcctctctacctgcgtgtcctcccttccaattcaaccctaggcactctggatacccccaaggggaggcagggaggagacccctccaactgttctccctgccctactgcagggtcacacttacacaggttcaggggtgtcatgtcttcccgtggtgccccccagggaccctcagatgggtgcagttccccatgaagggcccccggcagcatctcccgcttgatctccacccgtatttgttcaggcttcagcttcttgggcaaggagggtgcagccaggcctgggaacatctttcgggccgtaggaggaggagaggcagttggtgagtggcccagggggctgcccggtggtggtggcaacttcttggccaagggtgagatgtgaaggtccgaggggctgcgggcttccagtgagctgccaggacctgcgccgcccatcatcttggccagggcttttgggcttggccctggtgggttgggaggtccaccaggccgagactgggtccgtctcttcaggatctcccgcagcgtgtcgatgggcgagccattgacgtaccactcggtcacgcccatttgccgcagatgggagcgcgcgtggctcgagaggcccttgcggttctcgaagaactcaccacagaactcgcagcggatgtctcgtgctggctctgggcctgaggctgcagcaggaggagaaaggggcagttagcatcgtggaactgccagcatggtcacctgcaggagtgtcctggtcggctgggcgtgggcggcagcagcacgcccacaggttagggtggtgagggcaggtgcaggtaagggagtggaggagcggggctgggggccagatacccggcaggagtgaggggaggctccagagagcacatgggccctcagtcctggcggaggaggatggaaccaagattccattgctctgtgggtcccaacaaggacagggtgaggcagggaggcagcctaggtgctatgtgccatccagacaggggcagatgtgggtgctctgcacactaaaaggcaggatctccccaccttggccttcattctcaggaagggtcatggaggtcaaaggccaagagagagggcctagcagcccactgccaacaagatctctgggcagaaccggcccactgccaagggcccctgtctactccctgccccagcagggagggggctgtgaccccccccccgggaggggctccagggcccgcagtgaggagggggcagctgaagcgagaacctacagaggttgagaggagacggctccacatcagaggcccagaaaatgccggcggctgcggcggccgagaggtcctgcttcccccaggggctggccatacccgcggccttcagcttggccttcttggccggcggtggggggggaagcaaggagagggccgcggaggtgggaggcggccgccccgggtgggccagggcgccgcgcctgggtgggaggcggatctggacgccgtccctcctgatgagcccgtggagcacgtctatgggggatcccttggcgtccggatcgctgacgcccaggtggcgcaggtgggcacgggcgtggctagacaggcccttgcgggtctcaaaccaggcaccgcacagctggcagtccagctctctgcccccgtcactatctaaagctgcggagacaaaacacagggggggttcacggccgccaccttggccggccttgggggcctgaggtaggagggtctggtgtgatttttggctgctcaggcagttggggggtccaagactcaggccgcagatttcttttgaagtttgggaagcaggacatcctgtttcctgcctagccctttggcatcgaggggagtgtagagagcttaaggactttgggtagacaggcagtgaccaaattctaggtaatcagatactcccagaccctctcccctaggatccctgctatgggagctatttgggggcgatggtggctgctgggctcacgcagccaagggcacacctgctcaaggccctgcccctggaagcacggcagactcagtggaagcaacttcaagggaacataaggtgccaaatggggggctccattgggcagggggtgagaccctggggtcacccccagactctaatgtccacaaagatatgggaaagcctgatgttgtaagggacgtccttgttaaacctgctcactgcacctggagggtttcttcccaaaccctgcctgccgtgcccacaggcagcccaggaggtggggcttcaccggcaggcgcagagagctgcctctgcgtggtggacagccaggaagacttgatgacaggaccaatcgtgggcacctcccatcaggtgatcccctgtctatccaagatgcttccaactaccactgagaaagctaggccacaggaaccctggttaccttcaccgcccctacccacaggcccagagaaagccaagagctgcccctcagtggcgagcatgaccctggcaggctcatcagccgcagtgaggctttcaggggaagatcagcaaagtaaagtgggaggcacgatccacatccaaggcggcccaaaaggagatgcagaggcttgaccaatactctggcctggctggcccaggacatgggagctgtagtccccaccgcccccacccaccctgggccctgtccctgggctacagcccaacctgaggtcccgaccctcccagcgccagaacctccctcggctcttgggacccacactcactgaggttcaagggcccctcatcctcagactgaggccactgtgcctttggggaggccggccgggggctcagggacagctgggggctcttgtcctcaggattcttaggggtaggggagcccgccagggccagtggtgtctttttgaggagtggagagctgggcgggtggcccaggcccttggccgagaagccgggaggcgacttgatggctttgttgacagcaggggcatccaagggcttggccaggctgagcaagccgggccggggggccccggcgaccacctccttcagtgagctggacttcttagccaggcctgggggcagcccaaggtgggcgtcaggcagacccttctgcttcacaagctcgtagaggaggtcgatgggtgcgccgctgctttccgactctgccactcccagctgccgcaggtgggagcgcgcgtggctggacaggccctttcgggtctcaaagcaggcaccgcagacctcgcaggtggtcaggctctgggctgaagggcaacacagaggccgggagagcaggctgtgaggcccacggcccagctctcccgcttctcctcccctgagagtcccactcacccaggctccatggaagtgttttgcctccgtcaggccccccaaacctcacaatgaccctaacaacgcagagaatagcttggctgctttgccaataagggttagaaactgagactcagagagggaaaagttgtgcccaagggcacacagcaggagatagagcccttctgtcatccagccagtgggacacctttcacaacctttcaggcctacggggtgccctggcaacaggttcacacaaacgctgacctgacagccacatgcctcactgaactaagttctaaccaccctctgtggctcaactcctgcccgaaacactggtccttgcagtctcctgcaccctcttccacagagcctttatccttgcctatctgcttctctgtctccccgttccccaacttgaatggccctcaagagcaagggccaaattcattttgctcctctcacctccctggagtccaccccagggcccgtcactagtcaataacaaccttaggatcaacagacgaagaaatggtgtcatgcgagagactgcacagctagcaaaggccagattcagcaaatgagctgggtctgagtatgagctctggaccaccacacccactgcttctggatgctgtccctcgccccgtgagggtgcagctcagggccacgcatgcccaggacagtagaagttcaagagagaagacagctgagtgccaaccttggtgcctcaaggtgccagagggaaaactgcgggcaaccttgggccccacattaaccccaaggcacgagagtgctcctgtgagtgtaaccagcctggccagcatcccctgccatgccacctgggccactcacccttgaggtcctgcagctcctgtttgctgccatgaggaacctctgcagccactttgctgctcagccgactggccacctgctccagggccccagggacaggcaggctcttcttagggagcgagggagagcccaagtccatggccaccattgcgttttcctcagaacccaggcctgtgggttggggagacaggctcagcccagacaaatttcaggctgtctatacccagaactaagaagatggccttcttccttatccttgatgtccgctctcactctgcgaagcgactcaccccaggaaagctgaggttccaccataacccccagcaccagtccagtgcagggacactgaggctgccactgacagcagacgccagcagctgcttccacacactacagcatggacaggtctggggtctaatgcaaatctgagcccaaactcccatcccaggggatctcaaagaaaagatctctctgggcagaacttgtgagggggaacgtctgcctgtctcgagggtgagggtgggaggcactcagagagggaattcaacacaacaccagggtcaggaggctggagaggccacacagaggcagggagccagggagccagggacagggaggtggcttcacagcacttgtgaggaatctccaccagacaagacagctggggctgcagagacaatgggggaccaggggtggcctactgatcacaagctgggccctaagtggggtaaggtgtctgcacctacagctatctgacttcggacagaaagagttggaatcacagaactttgtgttaagtttctgagacatctatcaggcccgcagcatccctgggtgaggagtgtgtggcagagggaaccaagggtgaattttcacgtctagttgttcaaaggggcctgggaggccagttgaactccaaatttagagttcagagcaaaggatgaaggaactgtgccaaatggggccttggaggcgttcagtgggatgtaacggggcagggggccatgtaggttctatgctcagtttgagtctcgcagaagcaaagagtaggcgctgaggactggggcaccgaggactttgtcaaagtctccgggtcgggtgggcgcgtctgtcagatggggcagggctgaagtgagtttccgcaccggacggaccggaaccgtggcaagggacgctcccggggctccaaagggggcaagggacatctgtcagacggggcaaaggtctcgaggagcggcggaggagtgtttctgaggcctgggaccctgcgagcggcgacagaaggccctgggcccacacaactaaagggcctgggggaggggggggtcccgcagactggacggaaggcgtcgggggcggcggcaccggcaggcgggattccgaccttcccctccccacaccctcccaagcgcgggctcttaccgggcgcgggagcggacgcgggcccgggccccggctccggctcggccttgggcccgtcccgcggcggcggtggcggtggcggtggtggtggcggcggcggcgggggtgggggcggcggcggcggcgcggggggtgccgcggggcccgggctcggggggctgggcgggggcgcccccgcgggcgcgcgctcccgggcgccccccgcgcgcggccccgccgccgccttgctctccgcttttgtcactcggcactgggcggtggaggcggccatcttggctccggcgcacgcggggcggccgccccaggcgggagcagctgagcgccgagtgccgagtgccgctgccgccgccgccaaacccgctccgccccgcccctcagggcgcgcccaggttggcctgccgagtgccgagcgccgagcgccgagtgccacgagcgaaaccgttcgtctgggccctgagggcggacggctgcagctgctggaagcttgtcgcgcgccctggctagcggatgcacccacgctgggcgcccagcggcctctaaccgccgccccagcccagtccccggacatctctatccctaggatgggaatcttccggcctcactcagacccccttaaacaacgtcaaaactcttaagagccccgacgggcggagctaggacctgccctaggaccctgccccattccctttccggaaagtctccatctccgagtcggggatcctggaaaacacctgatctccaaccacaagaatccctccagtatcatcctgttatccaaccgtcccccgacggtgccgttccgcagacctagggaaccccacaaggccggcaacacatttcaatcaccgcctgcttctctctccgattgtccccagctgttccttgacagttgggtggggctagaatcggaacattgccccgcccccaacctggcacccgccccctcctgcccacttagggagagggggcaggcttctaacgacagccttgcagcgccagtgcccagacctagccctaatgttgcatatccttacttaaggcaaggcttccaagatcttcccaatcactccctaaccgccaaccctctgcctcgcagttattcactgaaagactggtcatagctctccctcccaaggacaaggccagggcagtgccaaacctggctcctctcatccgtaggctgattccttataccccagtgcctcctgcacccctagccatcctcagagccagctctgtctcgcagccacccctgagacactacaagccagacgtgggtgagctgagtgcctggggagcagcctttagcagaagcaagaagcctgaggtcaagtccccactctgccccttcctgaggtgtcacctcaaccagcccctgtcctctctgaacctccaaggagagggggctttgatagccccaccctcccctttgcaggctcatgaatgcccttcaagtgggcttgtgagtgggtctgactgagcccagagtacagatctaggtaggaccccagcagctgcaagtaggaatagtaccgaaggggccgggtgcggtggctaacgcctgtaatcccagcactttgggaggccaagaggggtggatcacttgaggtcaggagtttgagaccagcctggacaacatggtgaaaccccatctctactaaaaatacaaaaaaaattagctgggcatggtggtgggcgcctgtaatcccagctacttgggaggctgaggcaggagaattgctttaacccgggaggcggaggttgcagtgagccaagatcgtgccactgcactccagcttgggcgacagagcaggactccatctttaaaaaaaaaaaaaaaaaaaagggccaggcgtggtggcttacacctgtaatcctagcactttgggaggccgaggcgggcggatcacaaggtcaggagatcgagaccgtgctggctaacacggtgaaaccctgtctctactaaacaaaatacaaaaattagccgggcgtggtggcaggcacctgtagtcccagctactcgggaggctgaggcagaagaatggtgtgaacccaggaggtggagcttgtagtgagccgagatcgtgccactgcactccagcctgggcgacagagcgatactccatctcaagacagagcgagactccatctcaaaaaaaaaaaaaaaaagaaggaatagtatcaaaggaagccccagcctccagcagtcccaggggcgataccccctgttcagacactctccattcctcagagcccaactactttttgtagccaagttctctgccttgtaaaggctcgtgcaaagccaggctgtgcaagactgggcccttcacttgtccactccctttgcagtgcccagtcctgggctccttcaccaaataggacttatggatttccaagccatcctccactagagacaccaccaaacaagctgctcagaagtctagctctacagctgtgtggctgtggcaaagaagatgacctatggtttccttatccttaaaacagggacatggccggtgcggtggctcacacctgtaatcccagcactttgggaggacgaggcaggcggatcacgaggtcaggagatagacaccatcctggctaacatagtgaaacctcgtcactactaaaaattagccaggtgtggtggcacgccctgtaatcccagctactcaggagtctgaggcaggagaatcgcttgaacctgggcagcggaggctgcagtgagccgagatggcaccactgcactccagcctgggcgacagagtgagactctgcctcaaaccaaccaacaaacaaaaaaaaacagaaacacagcaatcttagttgtacagacttacattgaggcataaatgagatttaacacgttaaaatcttagtacaggggccaggcgtgatggctcaggcctctaaatccctgcactttgggaggctgaggcaggaggattgcttgagcccaggagttccagaccagcttgggcaacacagcaagaccccgtctcaaaaaaataaaaaattaaaattaaaaaaccttagtacatagcaagcatttgataatggagtagcatatcaggtctgccggataaagcaaacattggttgaaaatctagactctaggccgggtgcagtggcttacgcctgtaatcccagcactttgggaggccgaagcgggcagatcacttgaggtcaggagtttgaaaccagcctggccaacgtggtgaaaccgtctctactaaaaatacaaaaattagccaggcgtggtggtgcacgcctgtaatcccagctactcagcaggagaatcgctggaacctgggagttggaggttgcagtgactgagatcgcaccactgcattccagcctgggtggcagagtgagacttcatctcagaaaaaatctagcctctaggctgggcacagtagctcacgcctgtaatcccagctctttgggggcctgaggcaggcggatcactggaaggcaggagtttgagaccagcctggccaacatggtgaaaacccatctctactaaaaatacaaaagttagctgggcgtggtgatgagcgcctgtaatcccagctactcaggaggctgaggcaggagaatcacttgaaccccggaggcggaggttgcagtgagccaagattgtgccactgagctccagccggggcaaaagagcgagactccatctcgaaaaaaaagaaaatctagactctagatctgcactatccaataggatccccactagcctggcactagcttcatttcaacttcttaacagccatacatgaccaatggtgtccctgtaagacgtgcagatatctagagaatatttccagccatcatctcagaaagttctatacaacaatgcttctcaagatagaagatgtcattaacagcaaagaatctggggcccagctgcctgggttttaaatccctgtttcaccctttccagctgtgtgacctcaggcaggttaattaaactctgtgcctcagtttcctcatctgtaaagtggaagaaataataacacctgccttataggattgttgtgaggatgtaaatgagttcatgtttgtaaagtgcttagaacgatgcctggctcccagtaaaagctcagtaagcatttgtcaaagtcactggcaggaaagatagtgaaaaactggatccagaaagagacctggcccagatcctgagtgaaacagaaaggacacctaaatagcagggtggttgtaaggaaagtcatcaacatactttgtaaagtgactcaaaatgcttccaggaaagctgagcggctgcccctccagccccgcccctccaatgctctgggcccctgggaaggatggggctccagcacagcccgtcccctccccttaccatctccataggctggcccagggtcctcagcccaggtgggtggaaagggcaccgtgagaggtaagcggggccgacgggaggtcaggaagctgccaggcggacccccaggctctcggcccagggggctggggggctgctcagcagcagaggtggccagcagctcctgcaggatgttgatgggtgagacagtgagctcccagttggtgataccgaagtcacgtaggtgggcccgggcgtggctggagaggccggcccgtgtgtcgaagccagccccgcagaagtcacagcgcatcaggctgaaggtgcctgggtcaaagttggccactgtggagagaggacaggactgcctgaggtggagagggggctactccccagccccaacccctccccatattcagggcttcaccctggactgcctttcttccccgtggctgtcccttttgctcctgcctgctcctcagctctcagctcgtgcatcctcccaccccattccaggaagcctgaccctcccagatacccccttcccacatctggcaacgtcaaggagggacctcttctgcaaaaacccttctccagggccaggtgtggtggctcacgcctgtaatcccagctctttgggaggccaagcgggaagatctcttgagcccaggagtttgacaccagtctgggcaacatagtgagaccccatctctataaaaaaattagctgggcatagtggtgcgtgcctgtagtcccagctacttgggaggctaaggtgggaggattgcttgagcttaggagtttgaggctgcagtgagctataattgccccatggcactccagcctgggcaacagagcaagaccctgtctcttaaaaagagaaagaaagaaaaagaaatgcttctccagttgtggacctgccatcatctatgagagtatttgattaatagccttctcgtgactatttttactcatgatcacgcaagtgctgtaaattaaatatttgttggatgaagaaatggacaaatggatgtaatgccctctgctgggagccttctctgagccctgcaactggagttagggactttgtctcagcttccccagcctcctggttctcccagctttccccgcatctcagccctgctcactcggtgtcgtcactgcctggtttcctggttgtcaccccttgcccccaacccctagtgcgtagacacacacacacacacacgcacacacacacactcaaacaccatactggcacctccccaagtgggctttgtgtctgccaatgtcagaaccacccagggtgctcctgttggaaacagacttctggaatcagagccttgtactgtgggaactgacaaaccttacaggcagccccagggggttctgaagctggccagtgtggggtggagggggtcccaccactcctggactgggccatgaactccaagagtccaagaactgctattctgtccactgctgtgtccccaggtccccagaacagaggggaaccttgctcagtaaatatttgttgaatggaggaatgaatgaaattctctgcctgaggctgactcttctacccacactccttcctccagtggctggaatggccaggggactggggcgtctccacacatccaccgaccaggtggccttcactgtggctctcaagtctctcaggagcagaggccccagtgtccccctgcttggcgctaagggagagaatttagatcaacggtgggttgcccagccatgtgtctcctgggcctttaaaagtgaagctgccctaccttttttcttcttcttctggaaggagaacctgcgctcaatggccttcacctcctcagcggagatgaaatggcgcacattgtagctgacgcccacgcggttcaggtggccccggacgtggttggccaagccgatgccgttgtggaagcgatcggggcagtaggggcatttccgctcctcgtgcttcagtgccatggccggatccccatccaggagtgtgtccagccccagcgggccgcccagcggcgcgtccaggagcaggaagtccagggggtgggcgcctgccagccccagctcctcgggctgcaaccttgggggcaccctggctgccgccatgacctgcggccccagcttcgccacgagcacaatgggtaccatccctcggagctgctgctgctgcccctgggtggcctctactgcctgcagggcctctcggaatgcctgcttcagctccagggccgcctgcgggatgaggctgggggtggctaggggtgaaaagaccccattttcaggggaaaaatccatctcggaggtcagcactacatcctcctcctcctcctcctcctcctcctcttcgctccaagggcgcctccgttcccccagcccttgtgggtggacggtgcttttgtttctcccgagctgtaaggagtagggggtggatgctagtgtggagggaaaggccagccttccgagaggcctctggcccgtgccatgcaggagtggctttgacagcgggaaatctctgatgctcagctgctggcatcctgggccaaaggccaggctggggtcgtatccagcagggttctcccgccacatgggggccaaggacggctcagctttgccaaagtagtccacagcagtgtcagggaagcaggcgtgagcatcctggctagtgcctggctggctggcagggtcttcctcataagcctcgccatcctcctcccagtggggatgggcatgcaccagcctcacgtgctccctgagcaggctctcgctgggcgcggggaaaccacagaagacacaggcgctgaggccaacggcagctccgtagggctgatagaggagggcgctggcctcagggctggggctgccagccccgctgctgcctccaaaaggctctttggtggtctggcctgggggctcacgcatgtgcagcttggcatgctgcacataggccctggatgaattggtgccaaagacacacttagggcactgcagccgtgcctcccggccctcgtctcctggaacttgcttcagcttttggatctcctcaatgatcttctcccgggaggcctgatgcagctgccggtgctgctccagggcagtggggtcagcaaaggcccagccacactccccgcaggccagcggggccaggtccgcagggggctcctggcccggggctcggcggtgctggctcatgtgctccaggaggtgctccttctgcttgaagtagatgctgcactcgatgcatgggaacacggccggctcctcgtcctcgtcctcatctgggctggccaccccttcggccacctcctccagcagctcacacaggtagggcccggtccggatcgggggcagtagcggctgcagccgctccacagaagcctccgagttcactgtccaggtctgtgtggctacctccgaggctgacgtgggtaggccccactcggacggctgggccagcccctccaggtcctccagatcttctctgccacccaccaccgccatgtccagcgtcttcggggtgtcttccactggcacaaacaccctcctgaagggggcgaggggtggcggctgggcaggcaggtccaagtgcagccctgcgtcctggggggatccctgctcgtcctcatcttggagccagtcgaacctggggcggccctgggcatgtttctccaaaagccttggttccccccggtggtgtaagaaccttctagagccctctagctcagcgtggggtttcatggttctcacaatgactgagtcctcgaatctccgctcagataggatgccctccccagcctcctggacaagggggtgctcccagggcccccggccatcaggggtacctgggaaatggcccaggagatggggtggtggggagcccggccggaagtccaggctgcctccatcccagcagctgcaaggaagtgccaatggggacaggttagccatgggctgcagttttccttcctagggtggtgatgggggtcctcccaggccgtttgaagcaggccccggagatccagcccgagggtgacaggggtgtgggggtgagggtgggaggtagggggagtccacgtggatccttccggacctatcgggtcaaaagccaggttcaactcctaggatgcacctgtccacaaagcctagccccgctgcattgtgggggaatgtacggagaccacccctgggccacacggggatgtggccacctctaagaagtctggtggcaacagtcaactctcatctctccccagggaggacccaagcctctcatctgtgctccaggctgcttctgtcttggttctccccaaactggggtgattttgctaatttagtttcacctctcccccagatttggcgattaactttgtggcagaacagttcaaaggaatgttccttttccctgcatctccccctccagaaaggcagagtcaggagaggttgaaggtccctgctaagcctttggccccagtgatcctgaccttcttgggcagaggggtgggagtggggctgggggaggcaaggtaaccactctgggcctcagttttccaatcctgaaattgggggtaattcccaagaactgggaacccctttgtccttatacaacatctgtggagctttctcatagccatcatcaacaaaaggtgcttgcaacacaaggcaggtgcttctttaaatgctcacaaccacaacctttcaatgaccccgcagggtgtagggtgaagatgacacaactcagtgcttgagaaatgctttgtttcacctcatgcctggcccagtgtgggttcttattatgaccatttgagatcggttctcccttccttttcaagatcctgcctccatcaggggatgccaatcacgcttatggaacagatgtggaaatgttccattcagatgttgggtggagaccataaggtcacctttctaagctccatcactgacatgcgatactaaaaggaccatcctcctggggctgtggcaaggattcagtggggataaacacatgttcagagtgtagctcatagcagctattattaattaattaataatattcttgctcattctgagagctattagtaatcctgataaacttactatgacctggccaggcatggtggctcatgcctgtaatcccacctctttgggaggctgaggtgggtggatcacctgagatcaggagttctcgaccagcctgaccaatatggtgaaaccccatctctactaaaaatacaaaaactatctgggcatggtggcaggtgcctataatcccagctactggggaagctgaggcaggagaatcgcttgaacccaggaggtggaggttgcagtgagccaagatcacgccactgcactccagcctgggcgatagagtgagactttctcaaaaaaaaaaaaaaaagatgactatgacttattagcacctgccaagccatttaataaagagtagggaccatcagcattgctcttgattcctgctctcacccaatgccccttggatcctcaaggcgaattcatgagatgcatcttatggactccattttgcagatgagaaaactgaggcccagagaggcctagtatcattctaagggtcacctggcagagagaggacttgaagggtccaacatccaggctcctgcccctctggccctgctcctggcagggataatgagagttgaccctctgtgttcattccagacctcccccaaccccagcacacgcccaggggcttgcctgccgggagctgactcctcctcctgcctggcctcctgattccctcctgtccccttctcattccccaggggcttatctgaggcctgggcatgtcctgcttgcccccctgccctccctgaggtcagggccagcatggcactcaccagctgctgatccgatgggtggcggaggtgacacgggggagggcttcgctgaggccgggatggggctgcccgtctgcaacagagaggggagaccctgaggggctggggtccccctggccggggccctccacaccccagctccaggagccctgccaggtgcctcagaaaggccctgctggctcccagttcctctccctgagaggcccgtggcctctgtggtcctgagccctgaaaggggtttctttggaagagtccccttggctctcctgggggaccccagggccttgctgccttccaaccctcctctctttcccccaacccagcagccagggtggttttttacaagcctcaccctggtaaaaactcacctggcttctcattatacctataataaaaaccagacttctattttttgagacggagtcttgctctgttgcccaggctggagtgcaatggcacaatctcggctcactgcaacctctgcctcctgggttcaagcgattctcctaccttagcctcctgagtagctggaattacaggcgtgtgccaccatgcctgggtaattcttctatgtttagtagtgacggcgtttcgccatgttggccaggctggtctcaaactcttgacctcaagcgatccacccacctcggcctcccaaagtgctaagattacaggtgtgagccactgtgcccggcctaaaaaccagactcttagccgccacctacaaggccctatgaggtcagacctctgctggtctctccaacttcccctctctctcctggcccttcaatgcctccattctgactgtatgggcctcctcaggaagccccaagcccacctaactcttttgggcctcagggcctttgcacctgctatgccttctgcccagggcactcatctctgaccgcctaactcaaatgagcccctatgattttctctctcagcacctgtttcatttctttcttagaactttctgaaatcacctggctctttcttgggatgactgcttgctgggtcccctactagcatgtagtcacagtagaccaggtactttgtcggcttcgttcactgcagcattctagcacctggcatggagcaagtgctcagcaaatccttgccagatgatgaacgaggcacctgttctaacctgagctgcagagagcccatccctgccttctgcaccctctcccaggcctatgtcctgaaatccaatcccctcctgggaccccctccccaccaacacagatggagccaactctctattatccgcctgtggagccaatgcctggagcgaccacaggaatcctggcctgcatctctgcccgccacacttgcctgacgtgggtaagcttgccaatcggggagcaggccaattgcccgggccaaggttaacacactgggggaacttgtgccccgtccagagcccgacagatgcaattgttggattagcctcaatttgaggatggtccagaaaaagggatagggctggggcgaattctttttccaatccctcatcatccaattggcccgagaaattgagagctgactgctgagagtcaagggataaaagtggaggtagggtggggagagggtgttgaccagaaaggtgtggtcactggctgagggtccttcttctgaacccaagaaaagggttgtgactgttgtgtgacctctggaaggggtggtgggggtatggaaatttgcatcatctacagcgcaaggtgtctcaacatcagcaccattggcatttggggccagatcattttctggggtggggtccatcctgtgcattgcagaatggtgagcagcatccttggcctccacacctccccagccctcggtcatgacaaccaaaattgtcaccaaacattaccaaagtgtcccctggagggggaggcgaatcacccccatttgagaaccaccaggatacactgatgggcagcagagctgtgcctgggtgcaagggctggttttaggatgggggtgttggagagggcgttcagagttgggaaagaaaggcctggcccagccaagaaacaggggctctagagaacatgtgagtcatagatttgacttttttcaggagagggcagccggttcacatataacctgccctagcatgacctagaggtgtgggtctgagggtcccgggcatcctgcttttgaggttctaggaccccaagctcccaagattccgggcgtcccagatttgatgattctgcgattgctgttgtctaagaattccaagagccaggggaccgcgtggcctctttgtctgagcaattccagcgaggctcctatttttagtggcagtgactttggaggaagcaggccaagcagtgccctgtgtccaagacaccttgggggtgggggcttcacccagaggcctccacagttgatggggatccaggagtccctacgggtcagatgaggcgctaggtcgcagcccttaggcagtggccatgccaaggggcccttgttggctcctgccatctgggttccccgagagagtttgcaaatgctgatggcaaggggtgtccataagcagcctgaactccaagcctggggttcaacttggtagagtggccaagaacctagattctggagccagacagatccgagttcaataccccaggggtgccctgaagggcgtgcctctcccactccgagccttggtttcttccgctgtgcaatgggaacagccaccgacccagtctcgcagggccagcaatgggtgccagcaagattgtagtaaatgctccatccagagaagtggcggtggaggggaagaaggctggtgggaggcctgggggatcagggctggttcagcgatgtctcaagggggaagcttgaggctagaccccagagcctcaggtccggtcactccatgctctgattttctccccaggctggggcctcaagacagcagaaatgatatgtcatttgtccctgggtgccctgtccccaacacaatgccaggcatgtaccagactcttcatcgatccatacagaccacctcagcccctgagtcttttctgaacctgggaggcccaaccagagaggcaggagctgcagagggggtgtgggagctctgggtaaacagccgtaacgggggacagaggaggcagcgggcacacccctgcccaggcagggaagtttggaggtggccactccagtgtgctcttggggggctctgagggctgagtggggataaaggaaggcccaggctttggggtggaatagcagccccagagcctgttcctatttataggcatcacaagactagtagggcaggtgcccgtgtcccggagggggagatcaagcgggcagagagggcagtgggagagacgtggtgtcccaaacccaggcattcttccaacattcaggccatgacctcactccaagtcaagccattcctatccctgcccccagctgctgagggaaaccttcaagggtgggcctggcccccctcagcagccacatttctctcttccccaagctataaaacagatgcacgtatgagaccctgggtgattccccagtgggagtgaggatgcacctacctgcctgcttttcccctctccccagacctggggcatctgcgaggtagagaagagatgtccaatccctcggaaccagacccagagaggaccctgggatccctagagcctgtaccctcaggctcccacaaaatcaaagtccccgcccagccctggccggctgtgcgacctggcacaagattctgcctctctctgagcctcagttattaactcagttattaatggcttagaggaggggattgctaaagtttccctgagtgctgatactctggagttgggtgtaccctctgccctcaggggtctcaccttgccaccccactgcctgacacctgcagatgccaccagctacctctaagccttggcatgtacacagccccctgcctagatgcttgcttcccccttggtctggctcattgtccctcatcctacctctcacttcctgcaggaactcctggttgctccccaccaggtgctttcctcatcacagccccagccgctgtgtcataacacctggtgacataacaccgggtcataacacggtatcataacatctgtctccccagcctcagatggtggggtctatgagagcgaggatggtgtgtgctcagtcaccgctgtgccccagggcgtggcccctagaagatgctgtgtatttataaatatccgagcatcatgagttgtaaaggtggccagagcaggtcaaggatctgtgaggatgcagcagggtggttaagagtgagggctgtcaagccatgttactccctggctaggtgacgttgggcaacttatgtcaccgctcagggtctcagtttccccatctctgacacgggataataataatgaaggctattccacagggttctttggagaatgacagaagatgatcttgcaaaagccttggcacggaggaagcccttgatgaggtgtttggagatgggggtggggggtgtgatacatcagcccactgttttccaggcataccagcctcctaccaggtccttggacacgtcaggctcctccccaccacagggcctttgcactggctgttccctccacccagaatgcccgtcccaccattcactccatgctccattcaaatgccactctatcagggagggtctcccaggtctcccaggcatgatcctggcactctgtttaatgccttcacagcatctgtcactacctgtccttctgatatttgtttagttgcttgttgtccatttcccctactagagtgtcagccccttgagggcaggaattcttgcctctttggtttacagctgtcttcccagtgcctagcacataccctggcacaccgaaggtgctcagtatttaatgaatgaataacacgtctggaggtggggagagtgtgagatacctttttgctgggtaaaccaaggggtagccagcatcgctgactacccagcctctccctagccactacagaagctgttttggcccgtggttcaggaacaggatacacccagacagccagagggagctgggatagactgatgggagtggggaatacctgtggaataagtgggctgggggcagggagtctggggtgctgagatgggcctctggacccaattagtatgctcagaggaggaagccaggctgacctgagttcaagtcccagctccataccacccagtggggagccttggtctggtcactggctcccaggacacctgttttcacaactgtcaaataagaaactaaacagagtacaaagaaaaggctctggacccaagcggaatcagcatcccagctcagccgctgctgcgctgggtgacttgactctctctgagccttggggaatgggctggatgctccctgggggccacacggcccattctcttaccagagatgccacctctgccatccagaatgtctcgggggccctccttggtgacaggcaggtaacgggtggaccggaagatgccaccttccccctcagcagcttcggccccaccctcgatgttctcccttggcgccgggccaggcagtctctctgggccttggggacgatctggtgcagccaggctgcctgccagagacccctccatcggattttctctgcttggatccactcagctgctgcaccggctcagcggggcattgtgggcctggggatagagagaaggaagtgcttaggggatggaggaaagggaatctgcctcagtttcccatccctcaaaacctcagtcctcaactttgcagctcactgcctcagtttacctcccagcccaggggagctaatggtgttcagaccttttccacacaccttctatcccaatggcccctaccctcagcatgcctccgtctccccatcaataactcctcccctttatacagatcctgcactgcctcagtttacccatattgacacatgcacactcagccacctggtcttcttccatcaatcttaccatttctccagacgcctcccttcattcacacacagctgcactttccccagtcctgccctcacatccatgcacacgcacatcctactgccatgccttcgtttcctcggcaagaatcccagccacttgtacactctgatcctatacaccgtcaggagtctcccatcattacccctttacttttctccattgggttgtcccataccaatgatccctgcacttttcccacactccaacccttcccccacacaggaccttagggttctccagcattaaccccttcacccccctccacacacacagcctcaagtgaccccagcattaaccctttcgcttctccccaacattatccctcatgcatacccagcttgggctcctccattccccccaccccccaaccaagattgctctagtcctcgggcgaaagaaaacgatagggctcctggtccagaaatgaggaccctggggagcgggggttgtcctctctacctataaataccttcaaggtaacggcggaaagtgaagggcaggaatgaggcgccctccccagggagatggtggggaggccgggcccaggcaaccggggcggggccggggcgccaggcctggttgcaggcgctgccctcgggggcctggggattcccagggggctcctccgtgggctggcagtcttggtgggggtccctacccaggcccggaggaagcacctgcggttgtccactgggtgggcactgcccgcggggaacgggcgggaccgcaacttcggagcactttggcagcgtggggagggggctcctacccggacgccccccaggggtcgcagaggtgggggctgcgccgcgcgggcccactcctcgggggtccagggtccgggggatgagccctccgcccgtgcaccccggggcaggagaccccgcgggacgcgccgaggtaggggggacacctgccccaagacccccgcccctccccccacctgcacggccccgcccccggccaggccccgcccctgaaggccccgcccccgcccccgccccggggggtcccgcctggcccggcccggcccggggcctcccccgccccgctacggctccgccccacccgcgggctccccaggccgggccgggcctcaccggggaggcggcgccgccggccaggtgccggggctcggagctcccctccttggtgcggccgtcgctgccgctaccgccgctgccgctcccggtgccggtgccgcggcctccgcagccgccgccgcctccaccgctcgggggacattgtcccttt

SEQ ID NO: 1088 - DNA, 62 bp, Homo sapiens
agccctccgcccgtgcaccccggggcaggagaccccgcgggacgcgccgaggtaggggggac

SEQ ID NO: 1089 - DNA, 48025 bp, Homo sapiens
cacagccccggcctgccccgcgtgggagaagccgcggttccgggcacggggcggtttttcctcagggacggagcggtccgggatgagcacggaggggcctggggatccgagagcgctggcgtccgccgtcctggagctgcagcggcccgtacgtgattcgggactgaacacgtaagggagtggggcgcgccgctacaccgcaaagccccaaagtggagggtccgggagggcgcgcacagcctcgcccggcgccgtgcagggtggctcctgaggcagccaggcccaagcgtgacctgccccgcacgcgtcctcagggccgccccagcctccagcccctgggggccggcgttcctgggctccgcccccgtccccgcccctcgaccgccgctgctccgcggggactcggggagctcgaaggaactctgggaaagtttcccgctccgccccggcccgagcggaagcgcggatggggcgtggcccggtagctgtggccgcgcccccaccgattgcgcatttcgattggcgttagtggccgtccgtcagcacgccccctccggtctcgcgtcccgattggtcgcgggggccgtcagtccggctccggcggcgggcgcttcccggggctgcggcggggcggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 1090 - DNA, 47394 bp, Homo sapiens
cggagctcgcggaggaagtcggcgggcgtctcgggctccaggtcccggccagaggaggagctcgctgccgggggacgctgggctgagcggccggcggcgcgggcccggcggcggcggcagcggggtccgggtccggagcgccacagtgcgtgaggccgcagacgtggcagggagtgtgggaggggctccgccgtgtggaaaacttaacctccggggtcctgcgcggggggtccgggcccggggtggggcagcgggggccccgggggcgcgaggctgggctcgggcaagcgcgggcgtgggggctcggccgtccgggccgtgggcaggtggagggcgcggcgggggtgcgcgggggaggccagggcgctcactgaactcggtcgggagcggcccccgcgctgccccccgaggccaggaaggcgcagcgtgtgggtcctcggggctgaaggggcaagcgcggggacgtggcctcggctgctaggaggccaggctttcccgtctactctgacgttttgaccttgggcaagtcatttttcgctgccctctgcccctgtgtcatcggtagcttctctgcccctcctctgagcatgggaagcctaaggcgatgtgggaggcctggcgctggtggagggcacggcgagagctgggcaggctgtgggtgatggaagagatcagtaggtgttgggttccttacccgatctgattaggtgccagtcacttaacctctccatgttttcgattcctttagggagtagaatgggagtagctcctatttgccaggcctaaaaacgagtgccgtttacattttttattgcagtctgtggtccgaagacaaccctatgaggcatcagtagggttttacaggtggggaagtggaggcctaaccaagtcagtgactttcttacagaattacaggtaataaagtcttctggaaggcaggatggtagcatgtgttgagtgtccgccagcgtctgccgctgtggtaaaatgagcggagataaatgaaaagacttctggaatgggcccatgaagataagtccgttttactcatgagcagattgagtttggttaaggtaacagtgatgtggatagcctctggagacagaactagtccaagtaccagctttgctcaggttattgttctgtcgtgccttgtcactccagcaaaagaaaaaaaggaaggcataaaagttgtttgaaatgcacaaaagtgtagggcgtgccaagcagtgttctgctgccgttgaagttagtgcaaattggaagttgaggcatctggtagcttcatgctttttgcttttacccctgcccctctcccagtttcagatgactatcttctcttgcattatgtctctagtttccctgttttttaaacataattgggacacacgggttcacagtaggttggaatatatatatatattttgagacagagtctcgctctgttgctccgggtggagtgcagtggcacgatctcggctcactgcaacctccccctcccgggttcaagcaattctcctgcctcagcctcccgagtagctgggattacaggcgtgtgccaccatgctcggctaatttttttgtatttttagtagagacggggtttcaccatgttggccaggctggtctttaaactcctggcctcaagtaattcacccagctcggcctcccaaatgctgggattacaggcgtgagccaccgtgcctagccaggttggaatatttgaacccaggataattggttacttcattggtgttgcacattcgattctgcctcttgtgtcttctctatgaaccttctttgctctgtatccccctttggataactaaatgataatgtatgtgaatctgtcccgcagctcctgtgattttctgggcaaaagcttggtctagaggggcgggatctgaacagtaagctaatggatggagctgtttcctgggtcttgctgttttccggttgggctgctcatttctttcgtgcagacttttggaggttgtggtctggcctttacagtcacgtcacatgtagtcgtcattggcaccgacttgctccttggctgcccttccttttcctcctgtttttcatgggtatgctgttgagcatgcccattggtacactgatcatttgacaggtttcgtgatttgtgagtgtgtgtagacaccactattggtattagatttagaattctaattttgggtttgttgacatcatctttttgctgcttatctcattcctctatccctcctaggctgattttatttggaaactgaatttggattccatctttgcctttctggctgtgaaattacctacttttagaaagcatctcaaatcttatatctgtaactgtcattcacatgccttttgaagaccagtctcagatttcagaggacctcctggagcataaacatggtattccacagataacttaaagccagaaattatttttaaaactaggactttcagcctccctctcactccgggggaaaaagtgattaaaacacaaacactgtttctcttttattccttaacatggttaatgacattaacatctctttgaatgttctactagaaatgccagttatccttgttgctctttatcttttatctttctgtcttgtcaaacaaagccatgttcttatgcacctgcagggtctgctactctcaggcctttgccaattctcacataggttgatatggtggctttctgagttgttttcctgacaatctccatgtctctccaccttctatcctctctcccgagtcactgtcctaaagtgtaaatttgattgtgtaatgaccctgctttaaaaattggatgaggccgggcgcggtggctgacgcctgtaatcctaccactttgggaggccgaggcaggtgtattgcctgagctcaggagttctagaccagcctgggcaacacggtgaaatcctatctctactaaaatacaaaaaattagctggctgtggcggtgtgcacctgtagtcccagctactcggaagactgaggcaggagaatcacttgaacctgggaggcggaggttgcaatgagccgagactgtgccattgtaccccagcctggaccacagacagagtgagactctgtctgaaaacaaaaaacaaacaaacaaacaaaattggatgataccttgaagcccctacctgataaagtccaatttctttttttgaagcccaatttctttatcattatgtgtaaggacctttgtagtctgtggctccaaattccttttccagccttatctcctgtcattcctcatcagggaacctcttgttttgatgaagcccagctttcctgccactctagtgcattgttaatgcctctgtatttttgcacacattgtttccttccgccttactgaatcccatgattctttcaagactcaactcttcgtgaagcctttttcaacttgcctaactctatttatgtttctttactatcataacacttcatgcatgcatttatgtagttgttatattactttatctttagtaacttgtgtttgttttggtagctgccttatgggtaggcttattcacttttgtatcactaatgtctaaaatagcatttaacaccaaggataccataagacaaagctctcatggagtttaaaatgaatctgggacatagcagatacgtaaaagtagttgtggaatgaattgactgtagaaaaagcctttcaaatatataaaattatattctagaccataagtagtgatctttctcttgtttttcaaacattcctttctttctttaggaaaaacatagaacggaaagcccagcccatccttgttggctgtcatacacgagtgctgtctccaagggagtcacaggtgtctcagatgtgagaggatcccggggagattgagcttactgcctgggaacttttggatttctggagaagcaggctgtggtagcctggctctgcgtcagtgaatacctgggaaaggagctggagctctattttgcttgctttctgcattcgtttcttttagagctaatggggacacaatattttgaagtttttccatttcgggtctacagcatttagtggtattttccttatagttatgttttccaaatacttctcaatttctttggttctgacatttcacaatgattttaaaaaaatgtaatatggaaattaaacttgaggttttcagaagctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 1091 - DNA, 43211 bp, Homo sapiens
gctgctttcaaggtgtctagatacagagtgaagaatgtcacagtaggaagtgcactggactaggggagtcaggagacccgggttcttgtgttggcaccatcactcatgagctacgaggtgacttcaggcaagtcctctctgagccccagcttaatcatggcacaattgtaggattgctttgagggtcagacgagaatataggaaagaactgcaaaagctgtaaagcacttaggagctctgggagagttgagagcttcaaagccaaggaagacagcccacacttcagaagaagtgctgcagctgcacatttgttcgtttaatcaggaattgtttatgaagcaatgtgtgttacatgctgggtgtgagtacctctctactccttcccactagagcagagagcttttagtctgggatggaagacgtattaaatacagacttatacaaataattgttattaatataatatgtaatacagtgcaattaaaaacaataattcatataagacacatgttaaatgcacacttacacaaagaattgttacaagtatctcgggtgtacagggcggttttattcctgcgaagtgcttcctggcttgagtgaatacttttatggtgctggagttgagagataacacagttaactgttgaaattgggccattcccgtttcacaggctgccattggacctgtcaagtgcctgagtcatgtgataatgggctacattgcgcagggcccctgggccatctccacaggagatgccagaggacgagtgcccacttgctggtcttcacagagcacgctgaaagtaagaggcatgtgggaaactgaccagggcggttagctgactccaaaattgtccagattagcaaaactgccctctgtggatctttgttaaagttgggtatggtattgtagcagtttctccagtcaggtaccttgtactagcgagtcaacttgatttttttttgaaaaagcaattatttaataataatatttacttccaggaattctaggtacttattgtcttcatcttgtccatttaggtctgtaacctaaaagttttaaaggactttttggtatgaattctgattagtaaaggtagaggaagaaaggaaattatttggtatccatttcaaatgatcctgaatggttagggtaagctttgctgcagtgacaaatagatccagacatgtaatggcctcacaatagacgtttatttttcaatcccataacaatctaaggaggctacaggtcatggtggtggttggagtttgtgtgtgtaggtgtggggagggagggttctttttaaagcagtagtccgaggattgaggctgctggaggctcttctattttgaacacccggcttctaaggatgtcctgggaatcagcttcccagttaaggggaagaggagaagagtggagggcaggtctggaagaggcgtgtgctgctgctgttcccattgcattggctggcacccagcggtaaggcgacatccacctgcacgcaggactgggaagtatagcccagctgtgtgctcagggagaagagcaacaacattctttgcagcaaaacctgaaacactcagtttcactttctgtgacttgttttgtaagttgttttcaataaagaagattaaaaaaagaagccaggcaaatgaaagcataggggaggagtggcagacacgcagttctcactctgcgactgcaggagtgtctcttgtttcccccttgtgcactttgaggaatgaggggatagacgtggtcccttccttttagttccccgtagcagagttcttgtaaggactcgttcaggggagactgataagggtctcatctccatcgggggacctcaccagggcatggagtgggtcagagtgggctgggaggggatagactgtcatcaaggtgaagagatttgaggggtggtggagggctaaactccagatctgaccacttcaaagtcagcaaaggccaggaattgctggggtagggctaaaagctgagggttagcaaagagaggtgggtcctggaatggggacccctggggtggaggacagagaagtcacactgttagaaagccgtcacagaaaaggcagtgtgggaatgagcttacttaagcctagggaatattcatttgacaaaatggtttgtgtacattctggtttttctaccctgacacctgagggctctaacacatttctgttggttattgtggaagagagtgtccaagggtgggagcacagatgccgaatttggtgtgtaggagaccaatttcaacaactctgggggccttgtagagtttgcaaagccccgtaagtgattctaatctctctgcacccacaagaacccctagtttagacacagcttccctttatctgtggtcattcaccacagataatttcattccctaaagaatcacaagcagcttctaacagtaaatgccctttacaggaggtgtaaagtgcacttgctgtgtagagagggaggcataccatgagctttgcgtgactcagggaaggaggatttttatggaagaagtagcatttgagcattcttattttgataaagttatttttgaactgctttttaaaaaggtatattaataagaatagaagggtgattagaattctagtgtagtgttttggttttatttttaaccatttagcaagaacattaatgctattaaaactgatgtgccttaggagaccctcagattggtgtggtagtcacatatttcttctgacgtttctgttgctaggtgttgacatagatttagagataggtgttgtcaccctcaatgtgggtggcttgagtacttacatatatattgtctcattctctgaattcagcatggcaggttattataatcctcgttttcataagcaaggctttggcgatgaatatacctgccaagtgtgggtcttctcctgcaccccacagcctcggaggggctttaagggaacattaagtgtaaagcgtgtaattgcagaggaggtggacacagggctcctgcggaggaggtggacacagggctcctggctcccagttcagagcatcacagcacctctctctgagaccagagatacaggttagttttcctgacctccagctgacgttagaaaagttatttttgatacatatatccaataagtccaaggggtggggaatccaataaaagtgttaataaaaatccaataaaagtaccagctctcccgccagccaaactatggctggtaacgccattccagttatataggttacttatcttagtgcacagaggccagatcaccagtctaagcgcccctcccccggtaccgaacctcagttcctcccagggtggcttcatgccagaacatattggaatataccgggactcccttgaagcagaacacagtgttccaacactcccattagcactttctgttactcctgtgtctttgttagatttctgcaaacacttaatcttcgcaacaagcattttggattcagacgtattttctgagataaatacataaataaaaatctatcctgttcatattaccttttccaaagcagttccctttgggactgaacatttttgatgttctgtcatcagtctgttgtgagctaccagggaggtctccctgtgggagcagttctgtagtatattcctagggattagagtgtaggctcctggacctcccagccgaattcttctccctgctcctcatccttcttgacccactcagtattcacagaacgtgtgctgcctcagtccatttgggctggtataacaaaataccataactgggccgcttataagcagaagtctctctcactcacagatctggaggctggaagtctaagatcgaggtgccagcagatttggtgtctggtgagggccgcttcctggttcatagacggcaccttctctttgtgtcctcacatggtggcaggagtaagggagctctctgagacctctcttataagggcactaatcccatttgtggggactccacccttgtgaccttatcacttcctagaaccgcattttttttttttcttttgagacacaatctctctccattgtccaggctggagtgcagtggcacaatcttggctcacagcaacctccacctcccgggttcaagtgattcttgggcctcagcctcctgagtagctggggttacaggtgcccgccaccacacctggctaatttttatatttttagtagagatggggtttcactatgttgccaggctggtcttgaactctagacctcaagtgatccacccaccttggcctctcaaagtgctgggattacaggcatgagccactgtgcctggcccagagccccaccacttcataccgtcaccttgcgggtgaggatttcagtgtgtgaatttcagggacatgaacgttgagtacatggcacagactatatgtctggccccacgctatctacatacagagttacagcagtgaaccaggtgggctagctgcttaccttggggcatgcttactgtcttttcgactctcaggcatgtgatgagacatctccatctcattgatggtcattatcaatgcaccgttgttacagtgaggtggctgcagaaggcttcgataaagccattcttacatacttcacaaaaaacgttccagggttcaccctgcatgtgtaggtacctcttctatacaaatctgccagcctctgtttgtagctgtttccaaaagccaaatgtagaaggccatcatagatttgggtgggcatcagacccttcaactgagcctgattttctcactggttatgtgccttttcgttgactttcagaagccttcggtacctgacacaccattcagctaagcaggcctgcagctggcctgaggtcctgggtctcagatatgagtggtttgatgttgatcttgctcctttgtgattttttgttttgtttgttttgttttgttttgtttttttccttcatgattttatccatgaaagcttttcttctccaggccattgtggcagtagatgttcacctcctatttaagtgagatattcactcttggtaactttctttagtgagtgtctccagttatttattttatttttttccttttttccttacccttcatcaggacacatagtgtctccagttctaattgtagatactgtactgaccagctctgaagcaattgggactgtttgaggagagagaaaagcaggcatgagtccactctgttggatctatagggcctgtggatttgctgcccggagtcctgcagctgctcctgctgttgagcattgtgtggggcacctcacccaggattttcgggtgttctggaagccatgttgccgctctacctgtctcttttgcagatatgcccagaggtccccattcaggcaaaatagtccttgcgttatatttgtaatatgaagggttttgaacacaggaaataaaatttcatcttattttttaaaaagagaacaacaagactttgttttctttccaatgtagaaaacttcaaatttagtttttaatgtagagaaacttcacattcatattttgtttctgtgtgaataagatgatttgctgttgttttcctctaaataaactggtcagcaacattacagaaccagcacaaaccagcacaaaaccatcaaagtggagggggtgtttgcttttctgttcataataagcgagacatgttactggttagtttagaaggtatttccagtaatacagaattggctgtatttgggctgctaatacacttcctgctttgccattaggtggcatctttataatttgaaggatatttcaatgtcttaggcaggctactcacataagccttgttaaatagaggaaacaggtaagtttgtatgcatgcagttggataatttgacagacagttttgagcatattttctcatctgttcctgatgacacttatcagacttagatgagattgggcgcgttcagggtggtatggccgtagacctatcagacttagagacctgaggtgccctgaagccatagagcaaccaagtggccagctgagggtgccagcccagccctcccgccaggccctcgccggctcaccacgctgcgctgtgctgcttcgtgagagtgagcgcatctgtgattgctgaggcctggcgctcatggggttgcacccagcttctgagttcaggtagttagacgatttccagcgtcctttcagaggggctctcagaactgcttttgtttgtagaattgattttggaaaagtcttaaaatattcatgaagtttttttttaaaaaagctggtattaaaccttgaaaaagttaactgaaatttggaagggtgatttctgaattagctagggaggaataatgaaaaaatattgtaaactatatcagctaaatcactggggtcttggctttatgtattttcaagcttaaaggaaatgtcaagctgggcacagtggctcacatctgtaatcccagcactttgggaggccgaggtggacggatcacttgaggccaggagttcgagaccagcctggccaacatagtaaaaccccgtctctactaaagatacaaaagttagctgggtgtggtggagggggcctgtagtcccagctacttgggaggccaaggcaagaaaatcacttgaacccaagaggtgaatgttgcagtgagccaagattgtgtcactgtgctccagcctaagcaacagagggagactctgtctcaaaaaaagaaaaaagaaaaaaaaagaaatgttgagtgagattctggcatttgataccatagtttagtggtggagtattctttattttctttttgagatggagtttcactcttgttgcccaggctggagtgcaatggtgcgacctcggctcactgcaacctctgcctcccacgttcaagcgatactcctgcctcagcctccggggcatatgccaccatgcccagctaattttttctatttttaatagagacggggtttcactatgttggccaggctggtcttgaactcctgacctcaggtgatccacccgcctcggcctcccaaagtgctgggattacaggtgtgagacactgcgcccgacctactggagtgttttttaggatctgtgaaaatatgatactggtagaacctgattttattctcttttgaccatctcctataaaggctaactttaattcttttttttctttttcttttttttttttttttgagatggagttgtactctcgtccaggctggagtgcaatggcacaatcttgggtcactacaacctccgcctcccgggttcaagtgattcttgggcctcagcctcctgagtagctggggttacaggtgcccaccaccacacctggctgatttttatatttttagtagagatggggtttcaccatgttgccaggctggtcttgagctctagacctcaagtgatccacccatcttggcctctcaaagtgctgggattacaggcgtgagccactgcacctgacctaattcttattttttaagaagtgtatctttacattttagtgtttcatgccataaggaggtagctagatcttacatgcagtaacagatgcagaagcatggagagtcttggttacacatggataagaattacctgaaagaagatgagtaatacaaaaccaagtatttcagtaccgttgaaacaaaattctaggcgcaattgttgctgtagtgttttgctaagggaagatatgaagttttctcctctaaaggtcctgaaaaggaattggcttctcttccatttgggggctgggggagtcgctcctgtcctttcaagtcagttctcaataccaaggggctcggggggctgagacatgtgtgccctttggtccttctttcaaggaaactgcagcctgttttattatcatgatgttttgcttctagttatgtgcttttcatgttatgtgctttttactacaattaaaaaaaatttaaccatttaacaaaaaagaaagttataaaagttttttgttatttaaaaaaatatatagccgattcttaaatacttttgattataatagaaatataaatggcctggagaaagttaaggaacagatgccaaacctcagtatatccactagtgacaacttctttttttgctgtgtcgcccagattggagtgcagtggtgcgatctcagctcactgcaacctccacctcttgggttcaagcgattgtcttgcctcggtctcctaagtagctgggattgcaggtctgcaccaccacgcccagctaatttttgtatttttagtagacttactaaaaatgtcttgccccctcctccacctcccaaagttctgggattacagacgtgagccagcgcgcccagccacaacgttttcttaaatgagcatttcatgaccaagtcttctagaaagtataagtagaaaaaaaaacttaagatcttaaaatgtcacttaggattcttcaattctaaggaagaaaaatgcgaagaaattgaaaggacaaagttggggggcaaggggaggggggaacggttggctggggtgttgacaaaatcgtgtcactatgcagaaacttgagtataatgtgctggctagcttgtagaatcggtgataactaatgaatatcccctttcttctacctgctggtatgaaacagtgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtatgtctcctctaaaactcttgcatttcaaaacctgtagtgtgtgggtcctttgactatctcctagtttaaaagtatttgtaaatgttgctgctgtgagtttgtagtcttcatgcaatagcttgacactttttttattgtgagttttccatgaagttttttttttttttttgagacggagtttcaatcttgttgccctggctggagtgcaatggcgcaatctcggctcactgcaacctctgccttttgggttcaagtgattctcctgcctccgcctcctgagtagctgggattgcaggtgcgtgccaccacccccagctaattttgttttttagtagagacggggtttctccatgttggtcaggctggtctcgaactcctgacgtcaggtgatccacccgcctcggcctcccaaactgctgggattacaggtgtgagccaccgcgccccgccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcagtggcaccatttcagctcactgcagctctgcctcccagctcagcctcccaagtagctgggacttacaggcgcgcgccaccatgcctagctaatttttgtatttttttgtagagacagggttttgctacgttgcccaggctggtctcaaactcctgggctcaagagacccacctgcttccgcctctcaaactgccaggattacaggtgcgagccacctctcccagcctggttgtctttaactattgtatgtttcctgctgtgggaactactataaccaactgtatgaggcagtttgaaacttacttatatcctgtctgatactgagtttgttccatatatagaagtctgtttcttctctattttgagttttttactgacaaggacttgtgaggtggccctgaccacgtggtgacatctcagtgactgtgggtgtgactggattcaacagttggaagataccaggatttggctgggagcagtagctcatgccttatttgtaatcccagcagtttgggaggttgaagtgggagaattgcttgagcccagaagtgccagcccagcctgggcaacataatgagaccccgtctctattttaaaataataataatattttttaaaaaagaaaatgctaggatttaaccctgatcatatggatttaacctgtagtaatagtgaagtcaaaactctgggtttctatcagattgcccaagaaacagttaaccgttataattttttttttaaattttactaatatagaaaaatatctgtttcagtttcataaattttgttaaaggctaaaccgagtttcagtccattctcttccaaagtgaatattttggatacagccatttagaaaggaactatgtattattgataaagtgtttacttctttggcatttaaaaataatttttaggagtttgaaaatgttccctatgttcctgaaaagtctgtgaggtttttcactttacatttgtctcagaatcattggtgcttagtaaatgttcactgaacaaacatgtagaagagattaggtaccactctaacactataaagagaattctgagtcccgactttttattttaaaaataaattaatgtgtcaccttcacaggaagaaatacaaataaaagctgggcgcaggggctcacgcctgtaatgccagcactttgcgggaggccgaggtgagtggattacttgaggtcaggagttctaggccagcctggccaacacggcgaaaccccatctctactaaaatacaaaaatgagctaggcatggtggcatacgcctgtagtcccagctacttgggaggctgaggcaggagaatcacttgaacctgggaggtggtggttgcagtgagccaagatcacaccactgcactccagcctgggcgacagagtgggattccatctaaaaaataaataaatacataaataaaaaagaaataaaaataaaagttttagcactgtcaaatgagaagagtgagattttccgaatcctgatgaccccaagcatgtgaatttctgcttaagcacatgtagacttgctgttgtagagttagtgggagcggggcactttgtgagtggcggtgtggttgtgagcagtcacctcctttttgtctgtccattcagatgttccctgtgcagcgtgtttctctgtacttgtttttactgcagggagtattgctggccatcacatcatgtgaagactggtctctgtctctttgcaaatgtgtgtctggtaatatgatagagccaaatataaatattgtttggattagttatttatataatcagttggcccataaatgtgtttttatctctttccactattaacatagataattgaaaattagtgtgtcttatatggattaacagcaggtcaacagtcatcgttcatttcttgtccatcctgtttgggttctctctacaggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctggtgagtgagtgctggagtcgggagatgtttcctctaaaagcacgtaactttgcttaatgcacgcttataatcagaggatcttttcagaaatggtttccatttgccttcagaagacattcagactccttagaggcatttaaggccttccgtgtctgccccaccctatgactctagcctctttgttcacttccactcaacacagcttccctgagttctgtctacagctcatctgctgtgccctgaccacagactgcacattccttcccctccctgggttgctctcatcctcccaccttccccacctggagggttcctcatatctcccttgacttctttttttttttttttgagacagagtttcccactgttgcccaggctggagtgcagtggcacgatcctgactcactgcaacctctgcctcccaggttcaagtgattctcctgcctcagcctccccagtagctgggattacaggcgtgcgccaccacacccggctaatttttgtattttcagtagacatggggttttaccatgttggccaggatggtctctgaaactcctaacttcaagtgatctgcctgccatcagcctcccaagtgctggggttacaggcgtgagccaccatgtctggcccattttttgtttgtttgtttgtttgagtgtaagcatttatagcaataaacccctctcttaaaacagcccaacagcattcattgcatttcataagttttggtatgttatgttttcattttcatttgtctcaagatattttctacttttctttgtgatttcttctttgacccattggttgttttaagaatgtgttttttgttgttgttggtttttttttttttttttttgagacagagtcttgctctgtcacccaggctggagtgcagtggctcgactttggctcactgcaacctccacctcccaagttcaagtgattcttgtgccttagcctcccaagtagctgggattacagacatgtgccaccatgcctggctaatttttgtatttttaggagagatagggtttcaccatgtaatccaggatggtctcaaagtcctggccttaagtgatccgcctgtctcagctgcccaaagtgcagggattacaggcataaaccactgtgcctgggcaagggtatgttgtttaatatccatatatttgtggatttttcagttttccttctgctattgatttctggttacattccattgtgatttaaaaagatacttcatataataacttaagtggtttttaagtttgttgaaacttgttttgtggcctaacaggtgatctatcctggagaatgtttcatgtgcccttgagaggaatgtatattttgctgttgttgggtggagtattctgtatatgttcgttcagcccgcttagtccatagtgttgttcagatcctctgttttccttatttatcttctgtctggttgttccatccatcattgaaatagcagtgttgaaatctccttctattattgtgttgctgttggtttctaccttcagttctgtcaggggttgtttcctatatttaggagctctaatgtgtggtgcatatatatttatagttattatatcttcttggtgaattgacccttttatcattatgtccttcgtctcttataacagtatttaacagacagaattgacttaaagtctgttttgtctgatattagtatagccacagctctcatattattttgttcccattgaaaccctgagttacgtgtactaatgtttcagacagggaaactgaagctatagtttttcccagattctttaactataacaagttagtgttagaaccaagaccaagacccagttctcctagtttccaacaaaaatttgtgtaacatttctgcctgattttcctggcttttgaattgtgagctgtgattgcttttcactggtaaaaggttatctatgtgtttgtggcttaatctgctttttttctttctttttttttttttgagatggagtctcactctgtcacccaggctagcgtgcactgcagtggcttgatctcggctcactgcaacctccgcctcccaggttcaagtgattctcctgcctcagcttcctgagtagctgggactacaggcatgtgccatcatgcctggctaatttttgtattttttttcagtagagacggggcttcaccatgttggccatgctagtctcaaactcctgacctcaggcgatctgcccgcctcattaatctgctttctaatggccctttgcctcatgttattttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagctttgcctgtgctgtaaagaaggcgtctttgaagtcttccttgtacatcagtgcttatggtcaccctactcatggcctctcctgtgaatgtcttacagatacacagccaccactaagtgctctccgagtgtggatcccgagagggtgctgtggagtctgagggaccaccccctcctccccgaggctgaggcgtgtgtgcggcaacacctccccgacctctacgctgctgccggggtaggtctggaggctgcgggagaaggcggcatgttatttcactggaggaaagtgtactggtgattcagttcaattgaggatgactttatatttatttttaatgtctgtatttaatctctgaatgctttgaagcattcatgttgtcattgtccccagtggagaaataaaaggccatataattgtagagtcttagatgtagatgaaattttaacaaatcatttagtctgatttcccatttggttgaggaatcttctctgaaatatttctgaaaagtggtcatctagcctctgaacacttttaataataggatttctttacaagacagcccaccccattatcaacaagtttgcttatttgaaagggacagaaaaattaggggtcttgctatagtcacacaatgaggtaatgagaagctggaaataaccctcagtctccttgaatctcagccctgttgctccttttccagttcagggattcccagattttatcttcgaagctacgtgcaacctctgcgtgtgttttactggccacagagggctgggaacccaggcaactgcatttctgtttctcttgaagaagatgattgctgatggtggtggagtgggtcttctttcacaggatggttgaagtgagaggggatgggatgttcctttcttggaatgcattctttaacacagagacgtgtagtaacttaagaatggtaaaggctgggcgtggtggctcacgcctgttatcccagcactttgtgaggccaaggcgggtggatcacctgaggtcaggagttcgagaccagcctggccaacatggtgaaaccctgtctctaccaaaaatacaaaaattagccgagcatggtggcatgtgcctgtagtactggctactctggaggctgagacaagcaaattgcttgaacctggcaagcagaggttgcggtgagctgagatcgcgccactgcactccagcctgtgtgacagagtcagactttgtctcaaaaaaaaaaaaagatgaagatctgtgtccactattgactgtttctgtgtaagcgaacatttacagagacattgctaagaggagcatgctgtcttcacaaaataaactttccataatttcatatttatttaacttacaatgaacagttattactaataataaatagcaagttaacaccgtcatgctggagaactgccagattttattttccccacagcctgcgtgcggccctctcctgtgtctgcgtctctcatgcctcttgggtgggcgccccttgctggctgttttgctctggccctgccaagcacatatggacctgagagcccccatggcctggagagtagggtggggagatgacagggagctcatatttttagactgtctctctgtccaaggttctatgttagatacttcatccgtgttatttaattaaagaaaactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctcgcttccctaggaaaatgttaggctctacttcctccatatcccacttgtgggatggaaaagactcatccaccttatcctccatgcgggagaggctatggcgtgtcggctgctgattcacaggggccccgatggtttcctcagcagggtggggagtgcctggggggttgtgcatttgacaaacactgaacacctgtgtgtgtccgacagttgtccacgagccggtccactgtgaccggcttagaggagttagaggagattcctgatctagtgagggaagacaggtcctatgtaagtaaatgtgtgaaatggcattttagtgagtaatgagcattgcagagaaaatagaacagagagctgtggggtgaatgctgctttagaggggtggaaaaagcttctctgagcaggtagtgtctgagtgaaacctgagtgtggaggaggaaccgccgtttcacaactgtggggagagcagttcagagaaggtatagatgccttaagggcctgaagatgggaatgaatttgggacatgtgaggaagagaaaaagtgcagtgtggcaagggtgggagggaacacaagattgtgaaggatggacagggacagttgagggatcttacaggccccgattagaaggtagaataaggccaggcttggtggctcacacctgtaatccagcactttgggaggcgaggcgggcagttcgcttgaggccaggagctggagaccagcctggccaacaaggggaaaccccatctctattaaaaatacaaaaattagccagaaatttctggtggtgcgtgtctctaatcccagctactcgggaagctgaggcatgaaaattacttgaacccaggaggcagaggctgcagtgagccgagatatgccactgtactccagcctgggcaacagagtgaggctctgtctaaaaaaaaaaaaaaaatgtagaataaaactcagggtttgctgggcagctgggaagggccttgtccctgagctggagtgatggggacaggtagatcaactgtgcagccatcctggagaagcagagaccgtgggggctgggggccgggggaggggggtcccttccccagggagactggcccctggaagttgcaagcccttaaaggaaggtggctagtggcaccaggggagtgagtggtggccaggcatcggtggcaaggtaccaggaggggacaggattccccagaaatgtccaagagtttgctgatggctgccttcttgccgcatccccacagggtggagagaacactggcgtctcctcttaggaggaccccaattcttgtgtatcagggccctgcccttgtactctcacctaacattaactacttccttattccacacaccacattggggtagcgcttcaacacaggaatttcaagggacacacttcagtccatggcagtatgtatgttgatttttgttgcgtttctttgtttcttcctgttttttctgggagataatataatcacatctgaaatgttggattattaaaggtatttgttgcattggagaggtcgaggcttggagatgggctcttttcgctctggggatggggggcagtgcactcgattgttgggggagcgagtccaagctcacccccggtctcccccacagtccaggggagacttggagaggctttggaacggcgtgtgccagctgagtctgacgagtctgacgatgtcctgtgcctctgctgattgaactttgtcatctttggtccctcttggtgacttggagcctactgttttcaggtccttagtagtcagatcttgttatccatagtgtagtcccttttcttgggaccttaaaagatagaatgtgttcatgcgtctaaagcaatgtcatgtcataagaggtagacagtggagcgaccgaggctcagaaagaggctggtgttttatccacaggtgtagtaagtatcattcaaacaagagtctcagtgctaggagcagtgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccagggtatgtgtatatgtgcgtcagcgtgtgttttgtcttctgtcgactcttcctcatacttaaggagggagatgttttgcttcactttagcaacatcattgaggttaataatgtaaattgtgtaaaactcacccatcctaagagtgtgattcagtgacattgcctgagctgtgcatcagcatcataatctagctttagaacatgtttattctcgtaaggggaggccttttttttggtcagcttttgtttatccagtttgtatgtttggtttttggactgtctatcccctggacttttcacgtctttctgtttttcttacttctcttttgtaatgattatagcaagaaaaccatccaacttacacatgaacaacagctgattctgaatcacaagatggaacctctccaggtggtgaaaattatggcctttgccggtaagggagcccacatcaggttcacgaggtggtggttttctgccttttctccctacatccccttcccgctacctgccagggcatctttgctctgatctgtcatccaactaataattcaataacagatcaaataatcaatctcaaaagcaattggccaaggaatacttacttccccggaccactccatgaacatccacagaattcctgttgagacaggtagttcacagcagttagttggtcgggcagatgcccccgggattgagcccagcattgtgatgtttgctcaggcactgattgcttctggagagggagggcatgttaatccccagcccagggtttcaggagctccccagttttatagggtgatgtctagagggcctgccttagattggcttttaacttacattcataaatatattatctacaagtgtcctgcctcagtcagccacgccgatccactcacagcctcctgaagtacttggttactctttcatcacagcctttgctcgtgctatttgctattttttttctgcctgtaatcccttcctgctccttttgtggctaaataccctgctaacaacaacaacaacattttgaatgcctgcagtgtgcttggcattgtgctgatcctgatagcattccgtaaggttgcttagttattcttgttttatagaggaagaaactgaagcacagagagccttgcccggggttgaataagtggataggtggtggaggtggaattcaaagctggacctgtctctctccagagacatgccttccccctccctaaccctaccctcctatcctgaggggtcctttttgccctcgggaaccctacctctaatggatacccacttatttctgagaagcaaactgaagctcatgaggtcaaggggtccacctgtcctttgcccctcggctggagcctgccccagctgagatcccagcccaccttcacctggctttgaatctgctgctcttttggtggcactacttttaccagcactgaaaaacttgttactgtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgtgtgtggcacttgaagctacctcctggtgacattagagagaatggaggggacgttcaatagcaccaagccaggagagccacgtgctgttcatttgggatgggtattgcaggtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacagggagtgtgggacagcattatttcttctttcatttcttcagacctggtcataggaggttgaaggtgggagggtgaggctgtaggcccatggtgatggctgtgaattgttgggtattttctcctgtgaaggacactggtgaccatctcacttaagcctcggaatagtcctcccatttaacagagaaggcagacatggaacgacccgcctcagtttataagagcttgtcactggggctcctggacctcaaaactgatcttaactgaaggctggaatctctcctgattttcttgggttattggttctatggaatagattttgctagtgggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggtaggcggctgccgaatggcggggactggccaatgggactgccttcctggcgttacaactcctgcgtctctccttattttaggctacttgaaactctggcagctgagcaagccttcgctggcctcttttgacgccatctttgtggatgaggcccaggactgcacaccaggtgatacactgttcaggacatcagtagtgtcaaatacgtagaaacagcgccatgattatgtaagaggacacctgtgtgaactaagttgattattattatttgtgataaagaagaggatcttcatacttaccttaggatttcaagctgccccttcccctcacccaagcagatttctctgtcaccataggttttgcttaggttgttcttaacatgttgaccaagttgtagaccagcagacgacagggacctagactcatgctctgtgggaagagatcgtccattgacagggaaaagcttgtgttgtctacttctcaagtggctaggagagaacagacagtgttatccgtctgactttgtaggtcaattttgagtgctataatattagagaagacactgcctcattttagatttgcctgtgttgttttcttatattccaacaattcatccaaggcgaaacataatctgcattcctagcaccagaaactgtttcttttgtccattataaaatggctgcttttgatggagtgtgcctgtcctacaggaaaaggcgaccgtgaggtccagtgtgccctggcttagcttcgtggaagtgtttttgtccttttctttttgctgcctggggtggaggcctcaaggtttctcacttttcctctcgttggttacagctatcatgaacatagttctgtctcagccatgtgggaaaatctttgtaggggacccgcaccagcagatctataccttccggggtgcggtcaacgccctgttcacagtgccccacacccacgtcttctatctcacgcaggtaagtgcgcactctgcatgggaggcattgcatctctctcccaatgtcttacgtgccaggccctgtgaaaggtggtatgccaggctcaccagatctagcaaatccttgcttctaagccatggttctcaaagtgtggttctcaggggtctgccaagtcacactgttttcataagaggtgtgtgcacagcggtcgtctgaggaagagctgctgcggctgaactgtgaaccgatggctgctgccgccttgtacatttgtgcttagaacagttgttagaccagcgctggttgttcagacttgtgtatttggcactttttcaaagacaagtgaaacaagctgcgacttcagggaaaataactgacagtgtttgttgtcaaaagtaacatctttgctttcaagtgaaattaaaatgttggcaaactctcccataatgaatgtgacaactcacagtgtccttgattatgcgaaaagtttattatgcgctccttcctttccaatcacatgtctgtgtgaggttgaattttcttcatgtgtgtcagccaagacagtatatctcagcaggcaatgcagatgtgaacacaggaagccagcagtcttctgttatgccaggcattgaagagatttgcaaaaatggaacatggtgccactcttcttgctgcatttttttttgttctcggaaatatgtttcaaaaaatatgttctttatgtcatcatataagaggcttttggctgggcatggtggctcatgcctgtaatcccagcattttgggaggccaagaaggacagatcacttgaggtcaggagttcaagaccagcctggccaacatggtaaaaccctgtctctattaaaaatacaaaaattagccaggtgtggtggctcccgcctgtagtgtcagctactcaggaggctgaggcaggagaatcacttgaacccaggaggcagaggttgcagtgagccgaggtcgcaccattgtactccagcctgggtgacagaatgagactctgtcttaaaaaaaaatagtttttaatagttatttttaaatgaattaaaatttataatatggtaaatatagatagatagagctcatgtaaataaaagctctttggaggctttttaagtgtgatttttaagtgtgaagcatcctgagaccagcagttcgagaaccactgcttttaagaaacttatttctgattagaagagatgtctcacttggatgaaagtatcaactgtgctgtgttttgtgatgttattgaaagttccgtagacgcctctgtgactcttcccttgagctcctactgctgtggtgatttagggtagcgtcactgcagaggtgatttgttcttttaatagatggtatttttttagaacagtttcagatttacagaaaaatcgagaggagagttcccatatatcctgtactcagtttcccattactaacatcttatcgtcttatattaatgtggaacacttgtcacgataatgaaccaacattgatacattattatggactgaagtccatggttcatttgcatttccttagttttgaaataatgtcttttgtgacttcaggagcccatccaggatcccacattacatgtaaccatgtgtcatgaggctcttcttggctgtgacagttgctcagactttccctatttctgatgtgaccttcacattttccagaagttccagtcaggcatttgtaggctgcccctgtgctgggatttgtctaatgtcttttctcatggttaggctagagtcctgggttctgggaggaagaccacagaggtgaagcgccattttcatcacatggtgttgaggtgcatactgtcaccatggctcatgacttgatgttgaccttgaccacctggctgatgtagtgtttgtcaggtttcttcactgtagagttccactttttttcatcctttccttactggatgctttggaaggaagtccctatatgcagtccacactcaaggagtaagtgttggagaatcttcccaaattatttggaattcttctgtaaaggagatttgttttttctctcccatctatttaaatattcaatcatttatctatcttaatatgaactcatggatatttatgttataatttcggttatggttcactcagagtagttttatagcaacaaagtagtgtttgtttaaagtctagttttcgtttgactgttactgctattcaccaaagcacatgaagttgtgtgtgcatggaaaaaggctgtacacaccccgagtgtagggaagaatgatatcttgccagctggaggggcgaaggaagcagggtcttgggctgagttttgaaggttaggaagtgactttggtggatgaaagtcagacagaaaaccgcgtgggctgaggcagggcagcacggacaatgtgcaggtgctagtgcttctgccatggctggttggtgcagggcagtagttttaaaggtagtgtggagagggatctcaaaggcaaggggagaagccctccttacccgatcttcatcttttgtatgatttagacttcactagatttgatttggagaaaagggtagatttgcttaaaagaaaaatttactattggtgttgagaataatggaaaataaagactgctgagttgtgaaggaccttgaaagtgagcctgtgaagttcgctttccatgcggggggtcaggaacaacttgtagggtctggcccggccaggctgtggcagcagtgatggaaatgcacggacacaccacagggcgggctgctgactccctctgtcttgttgttttcagagttttcggtttggtgtggaaatagcttatgtgggagctactatcttggatgtttgcaagagagtcaggaaaaagactttggttggaggaaaccatcagagtaaggcttttagttactcttctcttttgtgttacaaaagttttcctctttatttcaatttgccatagagtttgtgctctctccctaaaggtggcattagaggtgacgcaaaggggcaagtggccttgttgtcccggaccaacgccaacgtgtttgatgaggccgtacgggtgacggaaggggaattcccttcaaggatacatttgattggggtaagagtacatttctgttgaccacttcatgcacagaaacgttgtagacgaacatacccaatggaaatgttcaccttccttgggattatcatgcaagaaagcatttgggtttttgactctttccaccaggctgcaccatgagtggtctctatcccaggccattctgattatgccagcgaaacattcctggaaaggcagacacaagaagggctggggaccttagtttccactcttttaacaatgaatgcccttcttcccttggcaatgccagtgaggccgcgggttactggaagcttttctagtcatgtgttgtcattagtgtgagaacagctgagctgacaacacgcagagtacacacctaggctctagttctgactggtcactaaccgtgtgtggcttggggcaagtcacaacttctgtatgcctcattctctccatctcagataaaataatgccttgccttacctgtttcacagggagttagaaggattcagtggcatgtttacagcatttttaaccctgaagcacagttatatgataaaaagatattcactcattcatttatggaaagattttcaagagcctactatgcattaggcactcagtgaatatagtagtgaatcataatcaaaaggtgttttaagttttttgtttataaagactatataacaatggtatagaaattttggaacctaaaaaaagaacacataatcccagtatttcatataataattctcatttttgctatttttgtctttgtccttatagatgtgtatttttgcataattgcaattgtagggtacacagaaatggatgctgtttttcactcaacacataggcatattttctttcattagtactttgatgaccttataatatttggtctggtagatataacataatttagccatggtcattgttgtaagagtagtatttttggaatatcatacacactggcatgatataaagtaagtggttctctacacctctcttaaatccacttactagctgtaccatgtgtcattacacgtgatcacacacctggttgtgggttataatgtcaactgtgttattttgcccgctgttttatgtgagtgttttatgtgtccctccctaaaagatgacaagctcttggagtgtggggccctggttgtgtctgtcttctatgtggggcctggtgctgtgtgagtgccggagcccagccagtgctcagcagatgcttttggaagatctgagctaaacagggcacagtcaggctgtctcctccaggagctgacctgttaaaatgtagaataatctggacctagagacgttctgtaatttcttttttttgagacagagtcttgctttgtcacccaggctggagtgcaatggtgtgatctcggtttgctgtaacctctgcctcccagtttgagagattctcgtgcctcggcctcctgactagctgggaccataggcgcctgccaccacacccggctaatttttgtatttttggtagagacggggtttcaccatgttggccaggctggtcttgaactcctggcctcaagtgatccacctgcctcagcctcccaaagtgctgggattacaggcatgagccactgcgcctggcctgtagttcttttctcacaagaaacagtggtaaatgtgcatacccagcactttgtattcaggtgccatttgtgttctttggaatcgtcttatgttcttggaagatgcttaaattgcctttttattgatgggaaagcagtatgcagctgtaggtcttgccctttttaaaagcgtaggaagagtttgaggtagcagctgtaacttagaatgtggtccctgtgagtgttcaggccacgtggcagccttgcgctttctgcttcatgaagtttcctgcttgccgcctgtgctttgggtgtcactcaagatccatttccaagaaaccatctcatttcaaaaccccatccctgcatttgctttattttgttttgttaaagcaacaacaaacaaaacaaaacaaaaaacaacaaaaaaacaaaaatcccaccaaaaaactttttcaggggattaaatcatttggattggacagaatcattgatatttggatccttcttcagccagaggaagaacggaggaaacgtgagtacccacctggccttggtgcattggaaggacgcacccaagtgacagggacgagaaagaagcaggcccagtctgagtcagggacccgtttccctccagagaagggcgagctagtgttgctgtcttcccatgacgaggggggtgcctcgggcctcctgttttcataggtactgacagatttttccagatcctcctcacaggagcctcagtctctttccaacactggtcccatagactgtcttcccctgcatccttctgtctgcctgggccaatttatacgttgatacttccacgtgggccccaagtgatagcgtcgagcatttctatagcgcttttcttttcctgttgactgcactatttcaaatccctgtgaagtaggtgaggatcttgagccgagggctttgctcctcagtcggagacggagaggctactgcactgcactgacttgcccagggacacacagcgagttagtgatgcagtcaggcctggaacccgggtctccccactttaagaccatctgctcttgcgcagctgcttaggaacgtgcagcacctgccaccatctgttagtggagcttgtgtcaccttaatttgtgtgtatattcttcttagaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttaccttccccctaagaggaggaacagatggtcttctgctgttctttttttttttttgagacagagtattgctctgttgcccaggctggagtgcagtggcgtgatcttggctcactgcaatgcccaccttctgggttcaagcaattatcctgcctcagcctcgtgagtagctgggactacaggccccaccaccagcccggctagtttgtgtattttttgtagagatggagtctcaccatgttggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttattgcttaagggaaaggggagcagagtcctggttcttcctcaggggctctttattctgttctactttcaagcccgtacaatgggattttctagtcccagctctgccacgtgtaatgtcaggcaagctgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactgaggcaagaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttggtaagaggccgccgggtagtgtcaggtgctgctgtatgtagtgagtggtgactggaatgcttcctttgcacggccttgttgtttgttggatggtgtggcctcctggtagggcacttctggaaaaactaaaccacaaaacacctcctagtcctaaacttttgattcttatactgtggttttttaaaaaacaaaacttcctcaaggtgcacccctctgggggctgcgtgtgggatgatgatgtttgtggcggccctgtgagccctgcactgccctcagctccaggttcttcgccatcagactttgagtctccagcctcatgaaagctttaaaatatagtttacttgcttaccatggcatttttttcctttcattaattcctcttcattttattaaagagagaagaaaaccacaaaaggagaaatagtaagcattctttatcatttgtctggtgttttttggtacagacaggggtctcactatgttgctcaggctggtctcaaagtcttaggctcaagcgatcctcccacttcagcttcccaaagtgttgggattgcaggcgtcagccaccacagacatttgtctgctttcttgttgttgttgttattattattcttattcttattcttcttattattattattattttgagatggagtctcactctgtcacccaggctggagtgcagtggcacgatctcggctcactgcaatctccacctcccgggttcaagtgattctcctgcctcagagtagctgggactacaggcacgtgccaccacgcccagctaatttttgtatttttagtagagacggggtttcgccatgttggccagtctggtctcgaactcctgacttcaggtgatctacctgccttggcctcccaaagtgctgggataataggtgttagccaccatgcctggccttgtctgctttgaaataaatttgtactcaaggctactttgtaataaatttgtacttttagcatcagtgctattgctttggttttaaatcttagaataaaactgtttgaaatttctgtacaaacaaacaaagctgtctgttaactgtggactggaaatttggggcctagcacacatcggcatgctgaaaatggaaaccacagtatttgtgaccattggcaaacatagaccatggtttggagtggagagaggaagggaggcagccatggagaagtttactatagtaccaccttttccctgcttctggtttacatgtttacaaatgtaatttttttgggggacatgtaatttacatgccacacaacccacccatccaaagtgtacaattcagcagctttttgcacggcctcgggtctgctgttctttgttgagttcctgccattgtgtagtgaatcgagatgggagatgagaggtgcggttgaacagcacagacacacagcacatagcacacctgtgtgtcttccttgttgtcctgtgacagtgtcaggcttttccagatgggactctggcagtccagagacagtgtaaggaaatggaaagagacgagcagactcggtcctgctcccaggcccttgattagccatgggcttgtttgtgggagtgacttaacctgtctaagcctcggtttccccgtctgtctcacgggcttgttgtgggaactggcataatgactgtaaacagccatctgtcacatcgcgggtgtcaaataaccaattaacacattcccaggatttacgtagcaggactaaataaaacccggtattttgtgccactagtctgctaggatttggtttgtttttggaattggcatttgtaggaaaattttgtatttacagccaacaaatgttgagtggttttctgcggggaatgggtgggggctagtaaacatttagatgagacataaggttttgtaagcttttctaaggctttttagttgatttttttcccctttactttgtttagagtcattttctgaggatgaatggaatttactgtatgttgcagtaactcgagccaagaagcgtctcatcatgaccaaatcattggaaaacattttgactttggctggggtaagcagaacgggcagcatgagctaacttgatgccattgaatgttatttagtctgcttgaggggctgacctggagccttcagaggccttcggatcaagatcctgggttggaagagaaacgctgcttgaacgtgcaaaggccgatgaccagtataagaagtgttctaaccaaggaaacaaaaatgtggttcttttctaagtcatttcctaattcagtttaaaaagctctgtttaagataccagcagtgggccaggcacagtggcttatgcctgtaatcccagcactttgggaggctgaggtgggaggatcacttgaggccaggggtttgagaccagcctggccaacatggtgaaaacccatctctactaaaaatacataaattagccaggtgtggtggcatgcatctgtaattccagctactcgggaggctgaggcaggagaaatcacttgaacctgggaggcggaggttgcagtgagccaagatggcaccactgccttctaacctgggtgacagagcgagactccatctcaaaaaaaaaaaaaaaaaaaaaaaagataccagcagtggtcatgtatttcttaatttctcctttactcaattagttctttttttttttttttggtttgagacaggatctcactgtgtcacccaggctggagtgcagtggcacagtcatcactcactgtaacctggaactcctaggctcaagcgattatcttacctcagcctcctgagtaactgggactacaggtgcatgccaccacacctgactagtttttaatttttttctagagacggtgtcttgctatattgcccaggctggtctcgaactcctggctaaagtgatcctcctgcctcagcctcccaaagtgctggagttacaggtgtgagccaccttgctttgcccctattctcagtgttcacagggaaaaatgccaggaaggttttgtgcacccagccttcctccctctcactctttagtcccttttgaaatggcatttgaaaagtagactttccagaagaacacatccttgccggggagagtaagtgttcaggcacctggcctttgtcacagacatgtggaaaagtgagctggtcagcactcactctttacccttcccacaaaccatcttctcacactctacttattttatctctttttctgcctaaacagctggagtataaaccatttagtcttttcaaccctgtcagaaactagaacagaaatttgagctaatagttactacttagtccatctttccctgaacccaagatatttaagcctgaaacctaaaacttaagtgtaaaagttaatataaatactctttcttgcttagctgtctccagaacaaagattgtgtgtagcaggatggtttattctcagtgccatattgcctactctcgtggggtgagccgcgccgtactgccctatgtgctctggggttgaaccacagggtgcaggcagggtgggcggtcaccacttttgagtaaatgatattcaactctcagaggtgttaagtgcagtagaaccctgatgctcataatggaatatttattgagggcctaacacttgccaagcacctttctgggtactggggcataacagtgggcagggaaattcctgccctcatagagcccatccaggcgaggagatggacaagaaagtgaacgaataggattttgaggaagataatatcaaaacttaaaagagagaagctttgcaaataaatactctacatgacacatcacagggcaaaggtttcctgcataaaactgattagcttgcatgtgtatcccatttttcatgcctcctttgtcatttttcctccaggcctctcttaggtaggctgacttggccataggaatgtttccagaatttgaaatctgatgcatttttcccagaacagcttttcacctgggcttcaccgagtgcaacagcttaagcgtcagagcttagaactgaagccctttttctttcgttgcatctttagccactaaagcacatggatcgtctgtagactttttctgtaaagggccaggcagtaaagatttcggactctgcaagtcacatgatctctgttgcagctacccagccccactgctgtagtgcgagagcccctgttgacagtacattagtgaacaagtatggctgtgttccagtaaaattaattcacaaaaacggccattgtctggatgtggcccacgtgtagtttgctgacctctggtttaaagaaaagtgtgactttaaaaaatctctaaaccagtacccccaggagttaagcagaataaatcattatgtacaaatagtctctacctatacaaacatttttgtataaactttggtttataagtacttttttagaccctccagtatggttttctcatggaagtcgtgttacagaagtggttaggcctgtcacaaaaccacattgtcaattggtagaactgtgcagggtattacagagcagtgatatcatctcacaacatgggctacacaggactttttgtttttgcttatgaaaattttgagacattaaaaagtaaagaaagcaatacactgaacattcatatacaaatcatacctatatgtacacatctccaaaaaatatgtacttttttccccataactaccatgccattttcgtattttataaatgttatcatatgtggcctctactacccgatccataattatacttttatgattgtctcagaaatgcctttttacagttgatttgttcaagtcagagtccaaaccaacatttggttgcttgtctcttaagttaaatagagagctgtacgggactccctccctgcttttcccatgctcttgtctcattgcataaactgggtcattcgtcctacagagcgtccccattcttggtttgcttcccggtgtggttgtgtaacttgttctgccatcattacctgtcctggctttccagtaactggaagttagccgtagaggcttgattcgattcaagcctgagtcttggcaggcgtgccccatgggaggccggagagggcttcgtgctttgcctcgtcacatgaggaggctcacagcctccttaggagtaggttagtttttccccgttagtgatgctgattgctcatcttttgaagaggcacagctaggaaatgtgtatttttgaaaagaaagaaaaaaaaacagtggttcatactgataatcccaatcccagtttttaaactttatttgtttcaaagagacaggctctcactctgttgcctaggctttagtgcagtggcacgatcatggcttactgcagcatcaacctcctgggcttaggcacagtcctcccacctcagcctcccaagtagctgggaacacgcatgcaccatcacacctggctggttttttttttgttttgtttttttgtacagacagggtctcactcactatgttgcccaggctggtcttgaactcctgggcttaagtgatcctcctacctcagcctcccaaagttctgggattataggtgtgacaccaggcaaatttcaacattttgttgttaaatataacacaagtatataaaacagcatatagcagtttaaaatgatgatgttgtgagcatccaccagattagaagatgggatctgccagccatcacggagctgtcctggtggcccctggccatcctagcaccctccctcctttctgagggtaactgccatctcagcagatacgcattaccttgctttgttgcacaacggcacctttttcttttttctttttaaccaggtatgcagcaccatcagtaagtgctgaaaaatgatactgtttacacatgttctcttcattctcctgggtttcaaaagctgcaccgtatctgcattgtcagaggctttggcccttcacacgttcagccatcataaattgtgttccataatctaattcacatttaacacgaaaggaattttacttcttttctcacacttgaatcttttctcatacactgaaatcttggttcctaatagtatttattacttattgatactattctatgtatttaaaaataatattcaaaataatgccagtattaatggaatactgactggacttgaagatttcctaacagctccatttctccatgaatgatgtatttattagtcaaaatatcatgttctgaagtcacttaaagtaagtcctttttgcttttgtggttttattaccaacttaatttgcagttagacatgtagtttattcataatacctacaggggttgctttgcttctttttgatttaatgatctttcttgatgtgtaaggcctgttaatgttttcaaagtcaaaaccttgcgcctgggcacagtggctcacccctgtaatcccagcactttgcggggctgaggcagacaggtcactttaagtcaggagttagagatcagcctggccaacatggcaaaaccctgtctctaccaaaaaatacagaaaaattagctagtcatggtggtgcatacctgtagccccagctacttaggaggctgaggtgggagaatcgcgtgaacccaggaggcggagattgcagtgagctgagattgtgccactgcactccagcctgggtgacagagtgagaccctgtctcaaaagaaaagatcaaaactttgtgataagagaagtctcattacctccctgttcacttcagactgttctctgcctccaccattggtagttattttaaacaattagcgattaatccttcagtatttctttatgcaagtattagcaaattcgtaggtattttcatattctccttttccacagaaggtagcatttcagatacactgttgtgtactttgctttgtcacttagaagccatgggaatcactcttttatttattttttactcttttattttttgcccttttattcttttatttgttgtcctacccaaattaggaaatccctctttatcagctcacagagctctctcgcctcttggtcagctgcatagtgttctgtgttgacgcactgtgatttatgccgttctcgctcatggacgtggtcacttccagccttttgctttcattaataatgctgcattgcacaatcttgtgcacaggtcatttctgtttttgccagtgcatcttcagcatgcatttctagaagtggaattgctgggtaaagataaatgcaagtgtgacttttctgttgttttgttttgttttgtttttgagacaaggcctggctctgtcacccaggctggaatatggcggcacaatcttggcccactgcaacctccgcctcccaggctcaagccatcctcccacctcagcctcccgagcagctgggactacaggtgtgtgccaccacacctggctaattctgtattttttgtagagacggggttttgtctgtttcccaggctggtctcaaactcatgagctcaagtgatctgccctgccttagcctcccaaagtgctaggattacaggcatgagccactgcacctggccaagtgtgacttttctagatgttgccaattttttcatggagattgttatcactttagagtcccaccagttgtatgcataagagtgaaataggcccggcgcagtagctcacacctgtaatcccagtactttgggaggcctaggagggcggatcacttgatgtcaggagttcaagaccagcctggctaacatggtgaaaccctgtctctactaaaaatacaaaaattagctgggtgtagtggcgtatgcctgtaatcccagctactcaggaggctgaggcaggagaatcacttgaatccgggaggcagaggttgcagtaggctgaaatcgtgccactgcactccagtgtgggcaacaaagtgagactctgtctcaaaacaaacaaacaaaaaagtgaagtagactttttaaagctgattggaaggttgtcagttggttgctgcatgcattttgttttccccatagaagaaaagaatacagaatctagagaaatacttccccattactgagactggggtgggctgtctgccctcaggggtcctgcgaggaagtcccagaaaaactgcctatttgtgggaacagattttttaaggctgtaagaccttgttagaagtggaggcactctgctgttttttttttttttttaaaaaacagagtctcactctgtcgcccaggctggagggcagtggtgtgatcttggctcaccgcaacctcggcctcctgggttcaagctgttctcctgtgtcagcctctcaagtagctggtagtacaggtgtacaccaccatacctggctaattttttttggtattttttttttgttaaagacgaggtttcaccatgttggccaggctggtctcaaactcctgacttgaagtgatccactcgcctcggcctcccaaagtgttgggattataggcgtgagccaccatgtccagccttttttgttgttgttgatcacagcctgtgaataaatttggggatatcctgtttcagaagtgtcgagtccagtctctgcccaggagggaaggccatggggataatgaagatcccgagttgggcagtaattcagaggctaggaaagcgtgttaaaaatagtggagccacggacgggggtgttttggagataaaaagcgagccattgcttcctgcgctgcctagaacgataagcccctttatctcccaagagtagggcaaccttctttttctttgacccctcccccttagaaaatatagctaatagaatcaccagaagccattttgttcatttgtttctttaagttttgggaaagtgaaggaaattattacattgttgaggtgttaagtgacatgaagttatgtttcaaagacaggtttttttttttgtttttttttttttttgagatggagtctctctctgtagcccaggctggagtgcagtggtgccatcttgctcggctcaccgcaacctccacctcccgggctcaagcgattctcaggcctcagcctcagagtagctgggattacaggcgtgtgctaccatgcctggctaatttttgtatttttagtagagatggggtttcacccatattgactgggctggtctcaaactcctgacctcaagtgatccgtttgccttggcctcccaaattgctgagattacaggcttgagccactatgtctggccaaagacagcttcttggtctcacagaatcttagattctttttgtttatttgtttagatacagggtcttgctttgttgcccaggctggagtgcagtggcacgatctcaactcactgcaacctcagcctcccgagtagctgagactacaggtgtgcaccactatgcctagctaatttttgtatttttggtagagacagggtttcgccatgttgcccaggctggtctcgaactcctgggctcaagtgatcctcccacttcagtctcccaaagtgctgggactacaggtgtgacccccaccccttaaatttatataaataaaaacagttaatctggtgggttatgagaggcttaaaaagagttaaatggcataaaatctaaagaaatcagagaacactgcatgttaggttaagtcatgttttgtgaaacttttcttccatgtgtgtttcttacatatgtgcgtatgtatagcattataatggtaactgcgtcaaaaacggcttgagagcctagccctggagaaacttctggagtggacagggagtcaggtacaggatgttcattgctgcattgttggaaatagtttggaaacaaccgagtaaccacagcaagggaatgggtaaatgaaatacaagagagcgctgtgactgagtcctctacagcattttagaaaacctaggtgaggaggaagccagaagcgtaacattcatgtaaattagacatctataaaaggagacctgtgtccttggacacgtgtaaacgagaagctatttcaccgtgggttggagggacctcgccaggttcatggtcttggctgtctctcgggaaggaaattgagatgacagtccaagggacttcagcaaaatctgtgacttcagacaggatttcacctcgtcagctgttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatgtacgtctgctgtctgtggaacttaattcagccatttgcattttttgcttgtgagctctgtgcttatctgggttgtaggtgaggagataagagagagctgtgtgatcctttattaggggcttttcatatgagaggcacaagaggtgtgtggtctgtcccagggtcagaggtcagggcacgtgatgctgcctggctgtgctgaagccgcaggtctgggaggctgggttgtgatacacgcttagagagagagctgttccctggggtcccagcgcagcttttcttggttctttatcttgactggataaatgactgtttctgagctcagggaatttgggggtgttgaggccacctagttggtggtgctgtgggaggtgttactctgaggatgtgcacccctctgaaaacatcagaatccaaatgcgttgtccctgggcagctgtgatgataactccatgctttttgctggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaaaaaatttatgtatttaaacttttattacaagatttcaattaaacaggcaccatagcactggcata

SEQ ID NO: 1092 - DNA, 47394 bp, Homo sapiens; identical to SEQ ID NO: 1090

SEQ ID NO: 1093 - DNA, 21768 bp, Homo sapiens
aagagagtgaaaagaccgcttacccaatttgaaattggtgagatgttccttgggctggttggtctgaggacctgaggtcataggtggatctcttcacggagtgaaggtgaggacaagggactggtctcctgaaggagtccctctgacccaggtctttggcaccaaatgtctcacgcattcgtgtgaagagaccaccaaacaggctttgtgtgagcaacaaggctgtttatttcacctgggtgcaggcgggctgagtctgaaaagagagtctgcaaagggcggtgggattatcattggttcttagaggttttgggatgggcggtggagttaggagcaatgttttgtgggcagggggtggatctcacaaagaacattctcaagggtggggagaattacaaagaaccttcttaagggtcggggagattataaagaaccttcttaagggtgggggagattacaaagtacattgatcagttagggtggggcagaaacaaatcacaattttggaatgtcatcagttaaggctattttcacctcttttgtggatcttcagttgcttcaggccatctggatgtatacgtgcaggtggcaggggatatgatggcttagcttgggctcagaggcctgacaggtgggtgcagtggctcatgcctataatcccagcagtttgggaggctgaggcggtcagatcacctgaggtctggagttcgagaccagcctggtcaacgtggcaaaaccctgtctctactaaaaatgcaaaaaatagctgggtgtagtggcacgcacctgtagtcccagccagtcaggaggctgaggcaggagaattgcttgaacctgggaggcggaggttgtagtgagctgagatcgtgccactgcacaccagactgggtgacagagtgaaactccgtctcaaaaaagaaaaaaaaaaaaaaaaattggccgggcgcggtgactcaaaactgtaatcctagcactttgggaggccaaggcgagtggatcacaaggtcagaagatcgagaccatcctggccaacatggtgaaattccatctctacttaaaatacaaaaattagctgggcatggtggctatggtctcttttggtaaataccaaatttaggaagcatgtattaggtgaaatattctacaaatatcaatcagattaattggttatgatatttttagttctgtatctttgctgattttctgttctattgattactgagaggagggttaagctctccacttataattgtggatttatccatttctcatttcagttttatcagtttgtcttcagattttttatttttatttttatttaagtttttgctctgtcactcaggctggagtgcagtggtgtgatcacgactcactgtagccctgacctctggggctcaagccatcctcttacctcagcttcctgagtagctgggaccacaggtgtctgccaccatgcctggctaattttttttattatttgtagagacagagtctcactatgctgcccaggttggtctcgaactcctaggctcaagcaatcctcctgccttggcctcctaaattgctggattacagttgtgagccactgtccccggccttcttcagatgttttgaagctctgttaagtgcacacacatttaggatggctttgtcatcttggtgacccttttatcatttgcatgaacagtgaagggtgtggcattttaccctgcttgtaagctaataagtcagtctgccagtttcatagatgctaacaaaagacatagattgcgggaacaatgacacaggaccttatcacctacaagagcagtggccatggtagtcacgtctgcatcagctccttgagcttcattttcaaaaggatgatgtgaaagggaccagatggcacctgcacatgtcggaggatgcactgtgggaccgtgggagaggatctctgaggttaggaatccacatctttaagaatgggagatgggccgggtgcagtggctcacgcctgtaatcccagcactttgggagtccaaggtgggtggattacgaggtcaggagttcaagatcatcctggccaacagggtgaaaccccgtctctactaaaaaatacaaaaaattagccaggtgtggtggcgcatgcctgtagtcctagctactcaggaggctgaggcaggagaatcgcttgaacctgggaggcggaggttgcagtgacccgagatcatgccactactgtactccagcctagtgacagagcaagaccccgtctcaaaaaaaaaagggagctgagccttcctgagtttttccccaaagggagaagttgtctttattatgctggatggaaaacaaacccgcccttcgctccagagagaggcctatttctatttccagtgctgttgactatatagatatccttgaaaagatactctagatccaaggcagtcattgcctctgctcataaaacatttagaaatgtgagaacttttggagaatatctttcaacaataacatctctctttatcactggtcatttcttttgctctgaagtctcctttgtctgatattaacatagctactccactttctcttggttagtgtttgtatgacatgtctgtttccatcctattttatttatttatttatttatttatttatttatttattttgagacggagtctcgctctgtcgccaaggctggagtgcagtggcgcggtctcagctcactgcaacttccgcctcccaggttcatgccattctcctgcctcagcctcccgagtagctgggactacaggcgcccgccgccacatccggctaattttgtttttgtatttttagtagagacggggtttcaccgtgttagccaggatggtctggatctcctgacctcgtgatacgcccgcctcggccttccaaagtgctgggataccaggcgtgagccaccgcgcccagcctccatccttttatttttaaactccctgtataattatatttaaggtggattgtgtgtgtattgtttggttttgtagacagcatatagttcggtacttttttttttaattcactctgaaaatctctttcacttggtatgtttagatcagggtcagcaaactatgtgggtcgaatctggccagctgcctgtcttgtaaataaagttttattaaaacatagccatgctcatttatctattttcttttttgagacggagtctcactttgttgcccaggctggagtgcagtggctcgatctcggctcactacaccctccgcctcctggattcaggtgattctcctgcctcagcctcctaagtagctggaattacaggtgcccaccaccatgcctggctaatttttgtatttttagtagagatagggtttgaccatgttggccaggctggtcttggactactgacctcaagtgatcggcctgcctcggcctcccaaagtgttgggattacagacaccatgcccggctcatttatgtattttctgtggctacttttctgctccaaaagcagagttgtgtggttgcaacagagaccatatggctgacaagttcaaaaatatttactacctggacttttactgacccctggtttatatcatttacgttgaatgtagttattgataggtttggattcagatttttatttccttttcagatttttattttatttcttttcggtttatttcctctagtctttatttctttattatccctttcctgccgtggtttagattatttgaacatttttagttttccatctgaattgaactctagagttttagttatgtatgtatgttttagtggttgctctagagattacaatgtacatacttaacatttcccagtctaattagaattagtattttgtcatgtcaagtggaatgtagaaaccttatcaccacgtagatctttttattcttcctcctttgtgtttgaatatctctattcatttagggctttcatttctctcagaaatgttttgcaatgtttagcatagggattgggcacatttttttcttaggttttttttttttaaggtattataatttgttcctagatatttatatgtttgatattatacgtggtattaaaatttttttcatttaaaaaattttttgaggccaggcactatggatcatgcctgtaatcccggtactttgggaggccgaggcaggtggatcatctgaagtcaggagttcgagactagcctggccaacatggtgaaaccccttctctactgaaaatacaaaaattagccgggcgtggtggtgggcacctgtaatcccagctacttgggaggctgaggcaggagaatcgcttgaactcgggaggcggaggttgcagtgagctaagatcgtgccattgcactctagcctggatgacaagagcaaaactatgtctcaaaaaaaattttttttgttgatatatggtaatattattgatgtttgtgtactgaccttgtagcctatgactttgctgaatatatttattaattctcattgtggtttattttatattttctaagtttgtagtcacgttatttacaaataaatatacttcttcctgtccaatctttagacctttcttttgtacaggaggaaaaattgcttccttcttcatttctaggttctgtggctggtctaagaattaattattattattattattttttgagatggagtctcgctctgtcgcccaggctggagtgcagtggcagcaatctcggctcactgcaagctccgcctcccaggttcacgccattctccttcctcagcctcccgaatagctgggactacaggcgcctgccaccatgcccggctaatttttttttttgtatttttagtagagacagggtttcaccatgttggccaggatggtctcgatctcctgacctcgtgatctgcctgcctcggcctcccaaagtgctgggattacaggtgtgagccaccgtgcctggcctcctgtttttttgtttgtttgtttgtttgtttttgagacagagtttcactctcgttgcccaggctggagtgcaatggcgctatcccagctcaccgcaacctccacctcccgggttcaagcaattctcctgcctcagcctccccactagctgggattacaggcatgtgccaccatgcccggctaattttgtatttttagtagagacgaggtttctccatgttggtcaggctggcctcaaactcccgacctcaggtgatccgcctgcctcggcctcccaaagtgctgggattacaggtatgagccactgtgccccgcaattttttttttttcttaatggataagaggttttttttcccctattaacatcaatgtaattcctgtgtgtgtgtgagagatctcagaaagggagagagagtgccaaggtcttgctctgtcacccaggatggagtgcagtggcacgatctcagctcactgcaacctctgcctcctgggctcaagtgatcctcccaactcagccgcctgtgtagctgggactacaggcatatgcctaattaatttttatatttttagtagagacaaggttttgccatattgtccaggctggtctcgaactcctagactcaagtaatctgcccacctcggcctcccaaggtgctgggattacaggcatgagccaccacacccagcctggttcctccccttttaaaccatataaagtaacttctgggtttgccatggcatttgtaaactgtcatggtgccagtgagagtgtcttttagcatgctagtgcattataattaatgtataacaagcactgagagcaactagaggttttgcagtttctttacggcatcctcagaaaacaagtcctgctgacctcataccttaggaatgccatctctgcatttccaaaggcgtcagtgtagtcttttgtaggctgcagtcttttgtaggcaagggataggcagatgctcctaaactataaatgcctgtgcgcgtattaaaaacagatacttctttggtgagactactgaaaaaacagtgctctttgatctggactattgtagaccttctcttacctaatacactccacctggggagatacattccttcatctgttttttgttaaaggcttttaataacttttagtaaaactacccaatatatgcatggaagaaacctgcaatttcacccctaaatacataaaaataaattttttaaaaaagttattgaggccaggtgtggtagctcatgcctgtaattgtagcactttgggaggccaagacaggagaattgcttgagcccaggagcttgagagcagcttgggcaacatgatgagacccccgtctctacaaaaaaaaaaaaaaaaaaaaaattagccaggcatggtggcacgtgtctgtggtcctagctactcaggaggctaaggtgggaggatcacttgagcccaggaggtcaaggctgcagtgagctgtgatcatgtcactgcattccagcttgagtgaaagagcaagacccccatctcaaaaacaaaacaaaaaacttttggtaatgaactataaacgaccctaataggaaaaacacattaagtcattaccagcttgtaacaccattctgtgacttcattgacacgttattatgtatttgtcacttagctttctaatgaccctgcacaattttgttggcagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagataggtaagaagttaaaaagagacctgatggaatacgtggcatcctggtactgctggggtccatccccacacctcatgctcatgagagggagacaagcttcttggagctcctcctcatctacagggctctcctcacagggcctggaagttctgccccagccctgtggggattttctagagtcatttgcctctctttaaagccttggcagagggagccggtgtggggaaggggtggtaacgtagatggcaatgcttgtcagaacatattagagccctcttccacgctctgcagcccctgggcctagggctagcattattctccccttttatagccatctgttgatttcaccttatctcgcactaagcaatgggcttcttgtgggcaggtgctctctctcacccatcttatttctctctggctctttcacggggcctgctgcatggtaagcgctcagtgttcagtgagtgaatggacaggaaggggcagggaagtgaatcaaatctcctcaggttgagacatcagcaccatctgtgatcctttcctcatttggaccttcacatgcaattaggctctaaaatccagtgagtttttttttttttctttttgacggagtcttgctgttgcccaggttggagtgcagtggcgtgatcccagctcactgcaacttccacctcccaagttcaagtgattctcctgcctcagcctcccgaggagctgtgattacaggcgcccaccaccatgcctggctcctttttatagttttagtagagatggggtttcgtcatgttgcccaggatggtctcgatctcctgacctcaggtgatctgcctgcctcagcctcccaaagtgctgggattacaggcgtgagccactgcgcccggtcctaaaatctggtgatttttatttccctgtgtctgtttctacggctgcctccctaagttctttctctgttgggtagtgggcttcggcctagctttctcatcaccgccacacccttccttacccatcctgtacagacagatagatttttctaatgtacattttcagcatatctctgggctgctcagaccatttcctcaactcgacacccaaattaatcagctcactcttccatgttttaccatcctatccgtccttctaataaatacatcctgagcttctggggaggaggtctcatctcagattctctgcccaagccagatggtttcaacatagtcctgcctctgagcccttatgcaagccatctccctgcctgtcccaactacttgcttctatccagagcttggtaagcccacttctcccagagaagcctcctggggtcatcccaggccacttcgaattttctctttggtagcacttggtcacagcaaccttgggcaccaagctgagtatagaatggagtccaatcaatgttgatatgatttttaaatggtggcgacagtcatgtgccatctgaagcaggaatagggaaagagaagcagtgactagcctatacaaattagccaggcgtggtggcaggcgcctgtaatcccagctactcaggaggctgaggcaggagaatcgcttgaacctgggaggtggcggttgcagtgaggcgagattgagccactgcactccagcctgggtgacacagcaagactccatctcagaaaaaaaaaccactctgggaggccaaggcaggtggatcacgaggtcagtagttcaagaccaacctggccaacatggtgaaaccccgtcgctactaaaaatacaaaaattagccgggcacggtggcgggcgcctgtaatcccagctactcgggaagctgaggcagagaattgcatgaacccgggaggcggaggccgcaatgagctgagatcacgtcactgcactctagcctaggcagcagagccagactccgactgaaaaaaaaagagtctacagagcctttcttggaaactagtgtggaaagagaagagcagcatgaaaagccgaggccctgacagcctgatgtcccgctccctccttcacagctctgtgcccagggcctgcctgatgtgcagtgctgcagagaatccagcacactctgctcatgtatgtgcccgggcatgttttctttcttggctacctctttagtcatttgttatgtgttatgaagaaataaactcccagcaaaataatgtcttttgcacagtcttaaagtgatccattacctaagatcatcatagatgattgtgaattgggttgacctgaaatcacctaagaccagggcaggttgaccagagatgaagatggaacatggtatgttgggaactgttgagtactgtgcccttcttactagggcatgtagtttaagtactgtgaaactcaaaacattttatttttcttattgcaaaagtgatacagaattgttctaaagcgtttagaaaatacagacaagcaaaaataaaaatctgccataattccaccatattctagagtatatcttttattcttatttatttatttatttatttgagatggagtttcatttttgtcacccaggctggagtgcaatggcatgatctcggctcactgcaacctccacctcctgggctcaagcgattctcctgcctcagcctcctgagtagctgggattacaggcacctgccaccatgcccggctaattttttgtattttttttaagtagagatgggggtttcgccatgttggccaggctggtctccaactcctgacctcaggtaatccaaccgcctcaaaaaaaaaaaaaattcaatattattattgataagtagggatttactcctaccattttgttatttgttttctggttgttttgccatcttctcttccttctttccttcctgtctttcttttagtgcaggtgattttctctggtgatgtgcttcatttttttgctttttactttttgtatatccattgtatgttttttgatttgaagttaccatgaggcttgcaaatactatcttatagcccattattttaaactgatgacaacacttactgcataaacaaacatgcaaataaatactaatataaactctacagtttaggctgggcacggtggctcacgcctgtaatcccatcactttgggaggctgaggtgggtggatcacgaggtcaggagttcaagaccatcctggccaacatggtgaaacttcgtctctactaaaaatacaaaaattagccaggtgtggtggcatgtgcctgtaatcccagctactcaggaggctgaggctggagaatcgcttgaacctgggaggtggaggttgcagtgagccgagatcatgccactgcattccagcctgggtgacagagcgagactccatctcaaaaaaaaaaaaagaaaaactctacagtttaacttcatccccctgctttttttttttttttttttttgagacagagtcttgcacggttgcccaggctggtgtgcggtgctgcgatcttggcttgctgcaacttctgccttctgggttcaaatgattctcctgcctcagcctcctgagtaactaggattacaggtgcccgccaccatacctggctactttttgtatttttagtagagatggggtttcactgtgttgtccaggctggtctcgacctcctgacatcgagatctgcctgcctcggcctcccaaagtgctgggattacaggtgtgagcccccatgcctggccatccccctgctttttaactttttgttattttcctttatggcttattgtactgtctatgccttgaaaagttgtagttatttttgattggttcatcatttggtctttctacttaagatgagtagtttatgcatcacaatttcagcgttatattattctgtttttctatgtgcctactattcccagtgagttttgtaccttcagatgattccttttgctcattaatgtcttttttgattgaagaaatccctttagcatttgttacaggacaagtatggtgttgatgtaatccctcagcttttgtttgtctgtgaatgtctttacttctccttcatgctcgaaggatattttcactggatatactattataaaaaatttttcctggccaggtgcagtggctcatgcctgtaatcccagcactttgggaggccgaggtgggcagatcacgaggtcaggagattgagaccatcctggctaacatggcgaaaccccgtctctactaaaaaaaaatacaaaaaaaaaattagccgggcgtggtggcgggtgtctgtagtctcagctactcgggaggctgaggcaggagaatggcgtgaacctgggaggtggagctggcagtgagccgagatcgcaccactgcactccagcctgggcaacacagtgagactccatctcaaaaaaaaaaatttttttttcctttagcactttaaatatgtcatgccattctcccctgacctgtaatgtttccactgaaaagtctgctgccagactggagctccactgtatgttactgtttttttttttgtagttgttgtttgtttgtttttcttgcttcttttaggatcctttctttatccttgatctttgggagttagattattaaataccttgaagtagtcttcttttggttaaatctgcttggtgttctgtaaccttcttgtatttgaatgttctttctgtaggtttgggaagttctctgatactatccctttgaataaacattctaccactagctcttcctctacctcctcttcaaggcctataacagatttgcccttttgaggctattttctagatctggtaggcatgcctcattgtttttattcttttttttttttttgagacagagtctcactctgtcacccaggctggagtgcagtggcacgatctcagctcactgcaacctccgcctcccaggttcaagcgatccccctgcctcagcctccggagtagctggaactacaggcatgtgccaccatgcccccggctaatttttgtatttttagtagagatggagtttcaccatgttggccaggctagtctcaaactcttgacctcatgatccgcccacctcggcctcccaaagtgctgggattacaggcaggagccactgcaactggccttttattctgttttcttttgtctctgtgttatctgactgtgtattttcaaatagcctgtcttcaagctcactaattcttctgcttgatcaattctgctattaagagacggacgcattcttcagcatgtcaattgcatttttcaactctagaatttctcgattcttttaaattatttcattctctttgttaaatttatctgatagaattctgaattccttctctgtgttattttgaatttctttgtttcctcaaaacagctattttgaattctgtctttaaggtcatatttctctgtttattcaggattggtccctgctgacttacatagttcatgtggggaggttgtgttttcctggatggtgcagatgcttgcagatgttcgttggtgtctgcattggagaattaggtatttattgtagtcttcacaatctgggcttgtttgtgcccatcctccttgggaaggcttcccagttatttgaagggacttaggccccaagcccaataatgtagttgtttttgcagactcagaaagatcccaccttggtggtcctggataaaatccagaaaaattctctggattaccaggcagagactcttcttcttttcccttattttttgccaaacacatgggtttctcactctgtgatgagccacttggaattgggagtgtggtgatgcaagcacccccgtggccatcaccactgggactgcactgggtcagacctgaagtcagcacagcaccgggccttcccaagacccttcccttcagggcagcgagttcccccaggccctgggcatgtccagagatgctgtctgggagccagggatagcaataaaaaaccttagcaatttacttgatgttctagtctactgtggctaagctggcactcaaaccacaatacaaagtccttctcacgtttccctgccctttccacagggagaggagcctctccatgtggccaccaccaccactggtccacagtgggttctgccaggcaaccgctgatgttcacctaaagcccaaggactcatctgtcagcttgtggtgaatgttaccaggcctgggactcacccttcagggcagtgggtacccctctggcccagggcaggtccagaaatgtccaagcgcctaggcttggacttggagactccaggagcctgcttgttgctctacctcactgtggcctaggtggtacctaggagcacagagcacttcagcccacggtggtggagcctgccgagaaactcaggttccagccgttgggatgggcagttcccccctggctagggctggtgcaaatgttccctccatgcacaggcactggctgagtccagcgcagctttattctcttctgtgacatggcagcactgagttcagtgtgaagtcccctagttgctgtgctctccctttcccaaagtgcacagatcatctctctgttccatatggctgctgccgggggtgggagaggggtggcgtcagtgattcaagactgtctctctgagcctcttcaatggcccttttagcgatatgaggttaaaaccaggtactgtgatcgcttacctgacttttggttcttgtgacggtgcttttttgcaagcagacagttgttaaaatttgatgttccagcaagggcatgaattgtgctctaccttctctactatagattttttaaagtctgcataattttgcattttatgcatgtgccatactgtatttgaccagccttcagctgttcaatgtgaggggctatggtttgaatgtttgtgtccctccaaagttgatacactaaaagctaatacccaatgggataggtttaagaggtggggcttttggggaagtgattaagtcatgagtgctctgctctcatgagtgggattagtgcccttatcaaagaagctcaagggcccctttgccctttttccctttacaccatatgaagatacagcctttgtcccttcaaccatgtgaggacgcagcagcaaggtgccatcttggcatctgctggtgccttgatcttagacttcccagacaccagaactatgagaagtcaacttatattattattttttcttttttctttttttgagacagagttttgctctttttgcccaggctggagtgcaatggcgcaatcttggctcactgcagtctctgcctcatgggttcaagtgattctcctgcctcagcctcctgagtagctgggattacaggcacgtgccactacacctggctaattttgtatttttagtagagatggagtttcatcatgttggtcaggctggtctcaaactcctgacctcaagtgatccgcctgccttggcctctcaaagtgctgggattacaggtgtgagccatcatgccctgccaatttatattatttataatgtaccctgcctgtgatattttgttataccagcaggcacaagtaagacatgagttaacttcattaaaaaaattatagacagtaattcactgaacattcttaccattaagtcttactacacacccttgattattcctttagaataaacttttgggaatagaatcactaggtcaaaggtcgtatgcctatttaaaactttgttattgagaaagcttgtgctaattttattgacagcagtggatgagagtgtctctgcttcctcaagtttttaccatcactggttattttatgtgtgtgtgtgtgtgtgtgtgtgtgtgtgtgtatacatatatatatatatatttttttgagatggattttcgctcctgttgcccaggctggagtgcgatgccatgatcttggctcactgaaacctccgcctccggggttcaagcaattctcctgcctcagcttcccaagtagctaggattacaggcacccaccaccacccctggctaatttttgtatttttagtagcgatgaggtttcaccatgttggtcaggctggtctcgaactcctgacctcaggtgatccgtccacctaggcctcccaaagtgctgggattacaggtgtgaaccagtgctcccggcctggttattatattttgaattttgcaaatgttataagtggaaatatctcttctaaaaataacagatggaaaaactttaaaaaaatcttgttgtaatttgtatttattccatgacaaatttggttaaaacctgtcatatttattaatcatttcttttgtctttagacttttgatgtctgtgtaaggcagggtttagttggaggtaacagaaaccactcttcttattttaaggagaaggagctttgtcaaaggaaattagctttttacaaaatcactgaaagggccggaggaacaggatctatgctgggcttccaagaatgactctgagaacaacaccctagaactagtggctcaggaaagctgctacttctgctccaggcagcttcattctagatattagactgttccttgctaggtctgctagagcttcacagcaaaaaccagtgctctgtgcctgctcccaagacacactaagctactaactgttatggaatctctgctaccatcacaacagacaaacaacaacaaaagtgaaaataaaccaaatgtaaaatacctcaaaatcctagcttaaatgtaacaaatacgtttttacatacttaaagcagatcagaagaataccaaggaaattcccagtggtcacaatggaacgaaactggagttgtaaactaatactgaagccactgctgtgcctaggatatttgtcagtcttgatgacctggatgcttaactggccatctgtgcctggtagataatgccttggcggcagtgaaggggttgcaaattagggatttgaaactgagaactccacatagtaccaagacactcaaaaagctacatcctcaggaaaagaatggattgaataaaagaaacaaaatctgacttttagcaaagagaaataacaaaaaaacttatctttgcctgtgccctgggtggagaaaaaaagcagcttccatggatgtgtaactccacatctttactcttaggggttttggatctgggatttgagtctacaccaagtggttttagaagttaattctatgatcccgagttggttgcaattctggacgtctgacagaagcaatgcagatccttcctggagggacatagtctcaacctaggccttatagaattcccacagataagccctagctgaacataaactttcactccaaattaaaaaagaatacatgaagaaacaagctaccataagagtcagcaagaactcctaagaacttaagataatggatttatcaaatgtgttatataaaacaaatatacctaaaatgtttgattacatttaaaaatacaagaaaagagcaagagatattatataatgtaatcatatacatgcaaaaaatatacaaattataagcatatagcttgatggattttcacaattggaacacatctaactagcacccataaaaaaacccaaaacattactagcatccccaagtcccctgcccccatgtttccttccagtcatgacccatacccttcacaagagtaagtactatcctaacctctaataatagcacagaccagttttaggcagattttaaaaagcactaaatagaacttctacgaaaaaaaaaattttaaaaccccaacaaaccaatgaatgaatagtagatttgacatagctaaagaaagaattgatatggaattaactggattaaagctgaaaaaattttctagaacacagcatggagagacaaaatgatgggaaaatagcaggagttaagagacatggaagatagaatgagggaatctaacctgcttctaataaaaatttcataaggagagaacagaaagaacaggtaaaaggtgattttcagcaagataatgtcagagagtttttcagaattgctgaaagttacatatccttagattcagaagtaatagcgaatcccaagctgaataagtaaaacaaatgaacaccttaacacattatagggataccgaggtcactgaagtaaaagagaactatgggcaatcacaaggaagagacaaatgacttatgaaggcacaacagtaagattaacagcagatttctcaacattaacaatggaagcaagaagtcagtggaagagtaacatctgcaaaatgctgagatgaagagattttcaggttgatttttgacaagtctacctgtatgctatttataagagataacaaaatgatgaaagaggatgaaaaaatatataccaggcaagtagataggaagacacaatttcataaagatatcagttctctaaatcaatctgaattcaattgcaattgaattgcaattctaattaaaattcaaacaggatttttcttggaccttgacaagctggttttacatttcagtagaaaaacataggcaagaatacctagtttcgaagaagcacaacgtttgggtttactctaccaggtgtaactacttattataaaggtctaataattcagagtggtactgatgaaggcacagaaaaatagataaaaggtttagagcagaaagcacagaaaagtgcccatgcctgtatagaaattgacaaacatcagagggtcatggaagatcagtggggaaagaatggtgtccagattattggtttttcatctgggaaaaaaaataaggctgaatgttcacattataaacaaaaatcaattccagggtcggctgaagatctaaacaggaaagagaaaagtttccaacttttagaagaaaatgcttatgaccttaggttagggaaagatttcttataagtcacaaaaagtataaataacaattagattgataacctcactgatattaaattttaaaactgtgctcaaaagacacaaagagtaaaaaaataagctatcgactccgagaaggtatcatatagtttgaatgtctttttcccaccaaatctcaggttgaaatgcgattcctatgttggaggtggggcctggtgggaggtgactggatcatgggggcggttctctcgtgaatggtttagcatcatcctcttggtgataagtgagttctcactctgagttcatgtgagatctggttgtttaagagtgttgaacccacccccaccatttttcttgctcctgctcttgccatgtgatattgcctgctcctccttcaccttccgccatgactgtaagcttcctgaggcctcaccagaagctgagcagatgttggtgccatgcatgtatagcctgcaaaaccattggcccagacacacttcttttctttataaatcacccagtctcaggtgttcttaaaagaacaaatggactaacacaagatatatgcaacatattttgcccattaaatattagtagtagattttataaagtatccaaaatatatggagacctactattaaaaagacaaacaacccgataggaaagacaggcaattcgctaaaggaaaaaccaaaatagtaaatcaacatagaaaaagttactagtaatcaggaaaatggacattaaaaccatagtgaaataccgtttcacacccttcagcttggctaaaattttaaatctgatgataataaatataatttacaagctgttggaatcccagaacactttaagcattgagagagatgtgactgtgatctgagtcatatatgattacaacgtctgtttctcagattatagattaacttactttcttatttttcttgttctgtacaataactagagagaattaaataacaccagggacaacaacctcctgtcttcctaattaatggcctttgttattgattaacatcccctttgttgtcctgccttgctgatcgcagatgacaaaacccatcgctattataccctttattttaaaaaatgctaaatgtagccttcccacaaacactgcctatcatcagtcaaattgctataactatgtaccaaccttgtatgaaaaatgttctaatcttgctaaaagctaccctgtctctccctgtataaatgaaaccttaacttccctactttgaactgccaactccattccttggagttggtttcctggtggactattctcaaactttgcatttgaatacactcctttaaaattagattctgacccttttgattatttcaggttgacagtaccaacaattgatgtggctatgaagcaatttacagtaatgataatataaattggtaatcacttggtagaataagttgaaaatatctaataaagttgacaatacacatacgataagatgcagtaattcccttttaggtacgcactgcagacaagcccttgcacatggcaggagatatgtcaaagaatatttaatgtatcattctgatacaggagctaaaaagaaattatttaggcagatagtgaggctaaaggagtccttggcaaggctgccttttaaacaaaaagcagcccccaaatcatttcttttctaacaaagagcagcctataaaatcaagctgcaaacatagataagcaagctggaagcttgcatgggtgaatgctggcagctgtgccaacaggaaaaggctacctggggaccaggtatattcaatatggagactccatcttcccttttctttgtcaccacgtgtgcagtaaagaagcaggcaacatggcaccggccaggtggagaccccacctgcatagtaaaagattagggtggggcggccagcttctttgcacgctatgcaaatggcacacccagtcctaaccagttcttcgtgctgtatgcaaatggcacaactggtttgaccaatctttcgtgccctagctaaatcagacactgcctcctcaagcttatctataaaacctcctgcgcttcactgtggacctgaagacccgctcaggaccccctctatctgcccgagagagcatttctctttctttcgcctattaaaccaccactgttaacttcactccttgtgtgtctgcatccttgatttccttggcgtgggacaacgaagcctcgggtattaccccagatgaatgacaccacgtgaattcttttatagtaggaaattggaaacaaaatgtccattatcaggagaatgaataaataaattgttgtctatataatggaatgctaaatagcaatgaaagtgaatgagctagagctgtggttgtcaacatggataattcacacaatgttgaatggtaaatgtgaacttcagaagtacacatgtggtatacttgtactggtcctagactggtgcaaatggggcccctgtcatgggtcccacatctcaggagctagggcagagcttggacagagacccagatgactagctttcctctccaccctttgcacagctcctgaggttgaccagatgcccctagcagctctgggctgcacctttgtgtccaagtcttggttccaggaagaactctgagcagattgctcctgttggctggtgcagttggctggtgttcctgttggcaggtggcatagcacaagattgggctgccagaatggtactaatatgctggtttgggcaactcaaattgtttatatagacagacgcccccacaaaaaatacttgcttatgattccacacacctttgggcatataaagcttaaaaatgtgcagtataggccaggcatggtggctcacacctgtactcccagcactttgggaggccgaggtgggcagattgtgaggtcaagagatcgagaccaggccaggtgtggtggctcacccctgtaatcccagccctttgggaggccaaaacgggcggatcacaaggtcaggagatcgagaccatcctggctaacacagtgaaacctgtctccactaaaaaaatacaaaaattagccaggtgtggtggtgggtgcctgtagtcccagctactcaggaggctgaggcaggagaagggcatgaacccaggaggcggagcttgcagtgagccgagatggagccactgtactccagcctgggcaacaaagcgagactccatctcaaaaaaaaaaaaaaaaaaaaaaaaagtccaggcgcggtggctcatgcctgtaatcccagcactttgggaggccgagacaggtggatcacaaggtcaggagttcaagaccagcctggctaagatggtgaaaccccatctctactaaaaatacaaaaattagccaggcatggcggcaggcgcctataatccagctactcaggaggcagagacaggagaattgcttgaacccgggcagcagaggtttcagtgagccgagattgcgccactgcactccagcctgggtgacagagtgagcctcccgagtagctgggactacaggcacccgccaccacaccgggctaatgtgtttttgtatttttagtagagacggggtttcaccgtgttagccaggatggtctcgatctcctgacctcctgatccgcccgccttggcatcccaaagtgctgggattccaggcgtgagccaccgcgcccggcctatcatgttttatttcttaagctgggtagtgggggagtaaaaggtgctgattgtgttattttttatgcctttgtgtattatttgatttttttttcttttttttttaagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaactttta

SEQ ID NO: 1094 - DNA, 92463 bp, Homo sapiens
ctacttcacagcaagatttattaatacatccaaaagaaagaaagaaaaatgattttgtcacactatatacagataatacatacagtgtttcatacacatattacatcagtttttacacaagaaaaatatacataaaaatgtaaacttttgtatacaaaaacccttaaacaaattaaacaaggaccagataacaaaaggagaccaattcattattatttcatcaaatttttaaaacagtaatacagtacattcattgagatatatatggaaaatgtgagccatctcttcttgtttaaagggaaattacaaaccaaaagtcaatcgcctcccaagacgtggtcctcccagcaatgccgcacccaatgccacaagtatgcctgtccaccagaactgggggctcttaccaaaacctgcccatctcctcatcttgctcctacagtctgtgcagaaacaagtggctcctaacttttgtgcatataattaaactcccagccactatgaacacaaatacagaggagagattgtcagtttgtaagttccctttaagcggcttttatatttttgtatttatttttaatgcatggcctgttaaacatacttgggtgccaaggtgaatgagaacactgaaaaagaagggctttgagaaccgctagtccttgctaccgtgcagtttctttgttagaagagattttaaaactgtccaacctgtctcatttgctggtttcaaataagctacctcacctttgatttcccactgcaacttggtttcaacttacacttcagtactctagttgttagtaccatacaattgccaagaggctttttgttaaaggctacttctgatatcaggttccagctaagctactcagtaaaatggctcaaaccccagcctctctattttagtcttcaggagtactcttacttcactgttttttgtaacatcttacaatttaggattgtccatctaccttcctctctctgcaagttcttgagatgtaatctgctgccaactcttcacaaaataaaataatatttaatcgttcttccttaatagtcttgcattcagtgtgtcaaattgatgtactaatgaaaaatacctaaactgtggggaataagaattaaatctatttcaagcacatgcaacttggaactcgcaaaaaaaaaaaaaaaagaaagaaagaaagaaagaaaaaagagtttgggagggcccttaactaaaatgtgcttaagacagcttcatgagagagctgccttctttcaaatttgaattttgaacaaggcaaaataacaattaggtgatatatttccctgcagcatgggagtagttaacttcccccaggcaaaatgatctcaataatcattatttattaatgaaaggaggaggcaaattggtgaattaagttgatctaggagatggtggctgacatacactaacggaaatattaggattgctttataagtgaaataaacagtctggtctgtggaacatctccacttcagagagaggaaaaatgcacaaagctcctcaagtgaatctccagctctttcttactctcatgggacagatggcatttttaaaatgacagtctccctttcagttaagaaaaacacaacaataaaaggaaaaggaagataaataaatagtgtgtggatgtctttagatgagactttaaatgttctttaaataacttttgataatgtattttaaatcattacatacaactgccactgcagtgacaatattccagtaggggcagcattttgctaaatgtaaaagattgccatttaaaactcatacatatacatgtgtatatacagttatatcaacactatttatatacatatatatctggagagcaatatttcattgcctttgaatatctatatatctactcccacaatatatactagagacatactgtgtgagtacatacgaaagcatatgtacacatgctctgacatgtatatatacacttttgtctgtgtgtgcataagagctttaaaggcacaatatatagggatgcaagttttctagagagctgcagcaaagttaatacagaatgtcacaaactgagaaaagtcaaaaggaaatatagcagaattcatcacacaggaattcatcaaagcagtttcatcatgagaaaaatgagttagttacagaattcaagaggctaacatgtgaccttgtatgctttccattaaaatgtaaatggtgaagttatgattaaactacaaagcaaataaaaatatgtaaatgacaaattaatgacagtaagtgtggaaataaacctaacactaatatcgatcataaaatcataattatgttcttttgtaatttaagtaaaatgtccccaaattattgagctaaaactttcaaatttgttttatttgaaggttggctttctgtttgtttttgagacaaagatgaatgcccaagtctcaaaattcctattgataatattaccaaaacttgtatcttctgggaaaatttcagagataaagatctttaaaagaaataacagagaagttgatgaaatatgcttaagccagatgcttctggctagaagagacagaattaagggggaaaaaaaccacaatgatgtgtgattttttttttttttttaagtgatgaaagactgaccagtagaaggtggtgaagatgaagaatagtggaactggcaagtaagaactgttcagacaagcattcattgtgtaatatccataaacaaaactataatccaaaggacttccattttagtatgttctgatgatgtactctagactgtcacctcctctggcttacagaataatccagaactttccatagacattaatcttgcttaacaaaggctgtttacctattatacacacacatttttaagggaaatatatgtatatagctttatctatacacacacatatacatacgtgtatatatagatttatacaaatgtataaataaacataatacttttcaatctttccattgacaaggcaagttcacattcagcaaagtgccaccacatcccatatacacatctctgtacagatatacacataagggtctgttttcacccttcaaccgggagaattttttctagcaaatcccattaaccagcaactgaagggagaaatggcaccagtacaaactcccttctttcatttgcatgcatatgtacaagaaatatgcagatctaaaaaaaaatcccaaaacaagagtgaatgaaaccaggagatgctgcaaaaatacaactgtagaaaagaacagcatatagagctttcctagatcttcactatatctaagatgaagtaaatgatgctcaagagacaactacaaattcaggtatattatcagaagttgctttgacatatttcaaagtacatgattttttaagtattaaaaataaatgtcattggaacatttaataccaactctacttttgactatttcagaccaccagatactccagtaataaatgtatagcaaaataacaacttaaaactcaaaataaagggatgtatttttttttaattccatatgaatcaggggtagcacaattttcctatagctgaaatatggggatgggagcactcttaagttaataaataacagcagaactgagtaaaagttttttgaaaaattttggaaataaatgaaatcaccccagctttgaaatatgcacggtgaaatgatcccaccaactccttaaacaaagcagccccttccaaaaattgtttatgaaaggcctatactttttcttaacttcaccaagaaaagatgatcaacaatattttcttactcgaatataaagaaatctataattaacataaaaaagattcaatagatctgtggtcccatcaccacaatagataaacacagctcatgtctggggctgtctgtctccctctcttatttttatgctcgaaagtgagaggctgatcttagaacctcctgtttctcatgtcattttatgaacatagcataatataagttaatccaaaggttaacataaaatgcacatgatatcagagctagccttttaacataagataacataatgattaatttggtgtatttatacaacagagacaatgagaaagtaactccaataccctcaactaaataaatcatgtttctacaatacattcggttacctttatctatttttatataagcacacattcatatctctcacacacgtgcccccaatgtatatttttgcatgtgtgtaaaaaatacagacatatacatgcacacaagtaatttagttctattttaaagtcacagtgggaattccttagtgaggagggataaaaagttcctgaataagacactgagaacatctagatttattattttctctattttacttcccaacttacagaataaactgtaaattaaagaataactccataggaaataaaagaggtcttacaaacttagtttacaaattccagctacagtagttggagttttacttgatctatgtatttctatgtaccctgtaactaagcttctagccatcttaagtgtaaaccacagatcatttactaaagaacatgattctcaacagttctaggaacagttataaatggtctaaaggtgttctacattttgaggccccaggatatccttttattttatatatctgcaaggtagcaaaggatagctatacaccttgacacggcagagatccagtgtaaaaaggtgcttcactagtttgttttgtcaaaaaaaaaaaaaaaaaaaaaagctcatatatatttagctattaaacacataggcaacataattcattacactcgatacagctttagtataaaacttataatttatgaggtgatgttaatagcataaattaatataccttttctcttaaaatctacaataagtattctgaaagctcattggggaaggaaatttttaaataaaagttttaaagctgtgcgtgatgggaaaggattctgtattctgaagctgagatgagagcctggaggagaaaggaaaaagtcctatgcaagacactgtgggctacaaaaccaaatgtttcctctttcttccgctctcttcaatgatgagtcacctttagtttcttttaaaactattttcttattttaaaaactgccctaatttccacaaggaatccctgagacatactcaatactatacagtgaaaagaactatcactgttgagaggaacagattcaacccttccaaacagatgaagacaatgtcaacaagtgtcagacttcccatcatttcagcactaatccactggagccaactgtaccttaatgatgcaggttggagtcattttagggcaaatcagtctattcccccaggtagaaccaatggtgtggcatttagctgcactggagccttctgcactgcgtgttgaaaatttttccaaggggaactttgggtgcatacagagcttacttcagtggtccccagcttaaaaaacaaacaaacaaaaacaaacaaacgaagaaaaaagaaacaagtgaaagaagaggattctatgactcttcgggcgggatgggtacagatcatatgtgcgtgtgcattcttcgggactgtggtgggcagacgcaagaaggcgaaagagaagatggaaagctgtgctgccctatggagctcactgagagttagatttttctcttatacgagtattgatctaaactttagatcactaaaaactgctgttcaaagtagccaaacatccccagtattggggaacatagggtaaaaaagtcatacccaatttgcttgctctctctctgaaacgtcacatttcctcttattagctctgtatcacagtgcagagaaaaactaacaaaaaaaaataagggctgaagtgaaaacagaatttttgctatttagaaataaggctccctaagtttgacccacaactgcagcattaatgacactgtttattagaagagacataactattcatttatgttttatgttttctttcctaattcattagtcagggaaaaatgcttaacagatatccaaacatgtccttcactggtattttattacaaattattggaaaggtagtatttaaaatgttactttaatctactaaacatgattctggtttcctccagaatataggaaaatgtataaagatgttaagacattattaaactgttttaacttttctacagaatgccagtgaagattcagttaatgtattgggcggggggaaacatctatgttctttcatatatatatataaaaaactctccactcccgagaaatatattttttgtcaggaaaaaaatccttggaacaatgtaaatactggtaacaaaagagatacaaatgaggactgttcagtatgatgaaattttctttcaaggaatcctctaaattgcctcattaaactggagagttctgttgaccatttagaagaccataatattagatttctatatataccagattaagaacagtatttttaaagaagtctgaaaagaaagatgaagaaactgaaaactaatttttaatgaatttcaaacctcttaataagtttagtgttcatatactcatctttttgcaataccaacccatagcgaccttctgaactaacctggaggagaggagattgccttacacgtgcactgctgaccgatgatgcccactgaccatcaccagcacccctaggatgccaaggcacggcaaagacggcgggcaagcatcagcggactgaccacacggcatttactagatatgctcaaattctaatcccactttataaaaacagaatggtataggtcaacagaaaggtcaattctttcatgtaagaagaaaaccgtatggacagggcacctctgtgcatcccaaacatggtttccttcctaatcaaagagttgtctttgccactgtggactgtgatcacagattgagaacaagctctgataaggaagagctttagtgtcagtcacagaaaatgatgattcttaactgcaggtgagagattgggcttatttaaaaataaatcttataaataattatttggcaaagataaagtatcagctttctttagcctcaagccactaaagacagtaacaccaattttaaggaaaaaaaataataacctcactttccaacttgctccccatgcctactatttgtttctgattaaattatagtcttctcatagaggggcactagacacaccacactgcctgccaacatgaaattgctcaggaagtcatttataaagcagttatatcacacatggtaggtcaccagagaaaataatcctttgctgtctaagctatgtgacgataattagaaaatttttccattgcatagtctgtcacttggtgggttaagtataattgctacttactattgagttgtttactagctacataacctacccagatgtgcaaattgctaagccatttttacagaagaaaaaacaatgtcttaagtactttaattaaaataatattaataattatgtagagagagtaaaggagaaaaagcccatcttttcttcagatactactgatcatagccagtgaatatcacacattagaatggaattcagattctcagagcacagaatgtatccattaactgcagcaactttgtaaattaaatcacagtaacacaatctaactggcctttataaatagtcccaaagaactgcagaaacagagtgaaacttctttgccactatttctcctgggttcaacactagaataaaagctagtttctacctatttaggaccttatataagatttgtttttcattccagtattgccttgtgatagcataagtgctattttaaaagatactaattttcatatttctggagtaaaagccacttcattcctttctatacatattaatagcaaagttcctactaatagacgagaatggctctattaagtaaaagaaaaacacagatctctctgggcttatagatgttctcctctcttccaaaaagggactcataagaaacagcaagagcaaagcaaattgcaaactttgatatctgttttgaactagataaaataagaggaaaagtttgttgttgataattcctcaaccactttcctcagctttcatcatgggcatccaaacgaaaatgtatttactcaaagtttttggtgtgaagctgtaactagcaacattcctgataatttcatgcctccttactagaaagcagagaagggcttttaaatgcacataaaacagaaaattgcaaacaataaaatgtgcaacttactgcaaactcagctttgtatcataactgaagaatttcaagcagctaacatgaggggacaagtagacagaaaaagttcaaatcgactacccacgactttcccttccttgtcaaagggctgatgaggaagtcaatgtgctgctctgcgacaacctttaaatacacaatggagactaaactgaactgctgggaatggacagttatctagttatgcttatgatggttgtgaaaatagtttaacaaactaaatgacatttttgagccgaggtaactactcgtgaccacttcattacagtacattaaaataaaaaagcttactaatatagactcacaggtgagaaatattcaaattatctgttctcaccattcagaatagaaatttatggtgataccaaatataattttgctttatgacataagttataatttagaaattttgcactctgcaaaaaaggcaaagctattaaaaataaatcttccaatcaattaccatgattttaaaaaaactaaatatattacaaacatatttttggcccacaaaaagaaacatcaataaatacaaaatagggcatataatgatttcatacagtcatgtgacatttcccctccataacctcaggcacgtggtatctgcataatgcctgctgatcaccatcattcctttaaaaagcagagaaagaaaagctttcaaaagaagggactggttagaactagcatggcataaagagattacatacaggaagtaggaaaatacatccaatcactacctattagaaaggaattaagatcaaatattccctgacaaatgaattattgaaccacatcaataggtatgttctctcaacttttaaaatatatatatatgtgaattagactagactcaggtataaatagccaatggtatctcaagggacagtgaaactactcagcaaaagcagagtagagatgcctttaaaatctagttccacccttctctgggggggaaaaaaggtaggcaagaaacctcacaaattcatctcatagtcacaaacttcctaaactaccccatatgatctttaacccctaaaatcctggcattttaaaaacatttcccaaagctattttcaaatttacttaaacccaagtacttgaattattttaaaaggaccaaagggcgaataaaatttatatctaatttccatattctgctttgaaagaaactttaaaatgtgtatccttcagatattacacatcacttcacaactggtacactgattctacaagtgtcttaacattttacaaatcttaccaaagaatcactactgtaaacatgaaaaattcaaaagcaaaagatggatcaaggagttgacagatcccatcttttcaaatctatctgacctatcctgctttttcacatcaaaatattttctttaattacatcttgcaaatgtattccatgagagagggatttagaaacaaacaaatgtctgaaaagacaaagtgaccatcaggccccagaaccccggcagcctgcagtcatcccaggcaagctttttaggacatccctacctcactgacgggaatccaagctttctatgttctgtttcttcttgggctaacttttagcagaaaaaggttgtgctactcacacgaccagtccaccaccctccctattcaggaaacttgaggaaaagaaggaccaaccttattaggactgtgagatgtaggacaggagaaaagtaagagttttatactcattaagtagggggaaggggagaacaaaaaaaaatcaaactaatgggacagctgcttcctgcactgcacaaaaacacacgcgtgggcacacgcatactcacaggcagtcaaaagacacatttttttcttttagttaaacatgatcacaattacgaatggaatcctggcctcactgtggtgtttagcagttggtgctaggtcagaatcttgacctgccacacaccatttgctgtctcttatacaggaactcaattaataagatcattctatctagaaccacctatgtaaaaacctggcaacagaatggaaagcactgatctgaatactaggaaatagtaaagggcactggtattctgaggtatcttccacttctaggacttgctgctaaaaatcaatcctatccagtcactgtgctgaaccactaaggaaaccactggggcggagtgggcctgccaggagggaatgagcaccagtgctaaggagcacatgtgaacactgtagcgaggtccactgcagggccactcattgaactgggaaggggggtgcccctctgatccccatctgttatatcttctttaggaaaaggggagaggggtgctaaagaggaaacaaagatagaaaacactgggttccccacctgcctgcaaacacacagacaccctcagttaggggagggaaagggagaagatgcattattggtacttgtagctgtggcacctgttactgtgaagcctgtaggaggggctatagagctgtggctgggctgcaggtccttaggaatgccactgtgagaactcagctggtggccaaaggctgcgctgaactgagggagttgctgcttgggagaggtggaggccattagttcagcagaaggccccatgccactgaagctggtctgtggtaaccccggaagcacactggagctgctgggggtcacggtggcgaaggcaggctgtgtggtctctgagttcgaagtggtgggtggcgtggatagggaagtggaaagaagatgtccatctgcgccgagaaggttgctaaatggagaggggtctccaaggttgacagggagattgccccagtgagttctggggtttaccacgcctccaagtggcacctcaagttgggttgggagcaagtgctgcgccatgatgggcatctctgctgaaaaggtagctgccatattatcaccagagtacgatgttgtgtggggagaggtgatatggtcactgtagggagacggcacatgctcactatcataatggcttccatggggtgaggagtgtgagtgatcactgctgtattgctgtcgtgaggtgattaggtcatctgccttgctcagcagctgggcaggatgtggcctctgggaggcatggctgccgtcatgaagtccatgaaactgtcctgggaaggctctctccccaagtgcactctggctgatcagagtggcagaagtaaggccaacgttggctggggcagagaactgcccctggatctgccctgccaggggtgtaggtgggtttgacaaggtagcagaacggagcaggttctcatccagctctagactagaaaaattatcatgtactatacgcccattcaatagctcccctaggtctgtgttcacctctcggctcaaggattgtattcctgaagctccagtacctgtggagaacacccctattcctctatctgacaactcctggactggcacaccatctgactgggcaaggaccccaatggtactcaggcactcgagagaagttacagcctgcaaggcccgttcaagctcctcagcctcttcggtagttgggaggaggtctccattcttccctgagtcaacaaaagccatcgacaatcagtagagcttttaccagttctacatcacaaaaatcacacatttgaattattttaaacaatattcgatttaaagagtccctcttgaaaagaaaagtttccaagattttgattggagggaaaaagtgaaataatggtctgcaggacagggtctgtaacgtcagctacctaggaatttgaatcaccatcttcagttgatttactgaataccatctcaaaaaccatcttatcaaagtactaaattcttaggaattctaaggattacaaatttaaagctcatggtgactatgtgattatacgtgtttttaacctaaaataatattatcatcattaacatagaaaacatatatcaacttggatttgagagaaaaggctgtgtagaacaggtccaccttgcctgttctactcctgactctcccagctggagggcagctgtggaaggttaaaacacagaaattcatacatctatttgagcacaacactaagctctcagttcatttcacgggttatctttcaaaatgcttttgctttactctctaatcctttcccctcatcctcttcccatttcttactaattttcataaaatggaagcccatggacctactttgatttcatttctaatatttaaaaaatctattgttaggaacttgattaatcaccatggaaatattcgatttttaatggtgaaagaaacattctaaaagtataaaatatttcccctgaaagcatgggggaattggcaggattaagcaaacttcgttttggaaaagtgcacttcagttgaagtacagggtggggtataaaactagggcaagttctaaaagacttcaaaactcatgttcggctgggcgcggtggctcgtgcttgtaatcccagcacgttgggaggccaaggcaggtggatcacctgaggttgagagttcgagaccagcctgaccaacatggtgaaaccccgcctctactaaaaatagaaaaattagctgggcatggtggcagacacctgtaatcccagctactcgggaggctgaggcaggagaatcgctggaacatgggaggcagaggttgcaatgagccaaaatggcgccactacattccagtctgagcgacagagcgagactccatctcaaaaaaaaaaaaaaaaagtcatattcgagatgtctttgttcaaaaataaagcaaaagtattcactttaaagaaacaacgttgggccaggtgtggtggctcatgcctgtaatcccagcactttgggaggccaaggcgggtggatcacttggggccaggagttcaagaccagcctggcccacactgcgaaaccccacctctactagaagtacaaaaattagccaggcgtggtggcacatgcctgaaatcccagctactcgggaggccgaggcgaaagaatcgcttgaacccggaggcagaagctgcagtgagccaagatcgtgccactgcactccagcctgggcgacagagtgagactctgtctccaaagaaaaaagaaacaagttataaacctagtcagcaaattatgagatggttaaacaaactgcacattccttatcttctgaaagggttaaaatagctgcagtggcattatatttcctatctacagtgaaagacattacatgtgaggaggaatatgataaacacatctcaaaacactatttcttttcttataaactcatttttaaaaccagtttccttgagtcaaaatattgactataccttcaaaaaaatcaaaatcttgtaagtcatcaggtagccgtggcaggacatctgaaaagtcctcctggttcaattccaagtcatgtggaatgtcagtgatctcattggcaatgtcatccggcaactcatcagcactcagctctggcgtggatgggctcctgggaaagaggacactgttggtcccataactcccccattatcttcacatcaataccaccaagccaagttcattcaacatgaaaagaagctaacgtcaggcagggcacagtggctcacacctgtaatcccagcactttgggaggccaaggtgagaggatcacttgagggcacgagttcgagatcagcctggtcaacatggcaaaaccttgtctctactaagaatacaaaaattagctgggcatggtggtgcacacttgtaatcccagctactcagaaggctaaggcatgagaatcacttgaaactaggaggcggaggttgcagtgagctgacatcacactactgcactccagcctgggcaacaggtcgagactctgtctcaaaaaaaaaaacaaccaaaatcaaaaaacaagctaataatgtcttttaggttttttatttaaaggtcagaaagccccggcaggtcttgaacccaagcacagggattagacagatggaaagtaaggaagtaaccacctgagctaaagccaatcctaatgtcttctaggtttttttttttagacagagtttcactcttgttgcccaagttggagtgcaatggcgcaatctcggctcactgcaacctccacctcctgagttcaagagattctcctttctcagccttcagagtagctgggattacaagcgcccaccactatgccaagctaatttttgtttgtttttagtagagacggggtttacccatgctggccaggctggtctcgaactcctgacctcaggtgatccacccaccttggcctcccaaagtgttgggattacaggcatgagccaccatgccttgcttttttttttttttttgagatggagtcttgctctgtcgcccaggctagagtgcagtggcatgatctcggctcactgcaacctccacctcccgtgttccagcgattcttctgcctcagcctcctgagtagctgggattacaggtgctcgccaccacacccggctaatttttgtatttttggtagagatagggtttcaccatcttggccaggctggtctcgaactcctgacatcatgatccacccacctcggcctcccaaagtgctgggattacaggcatgagccaccgcacctggtcctaggttttttatattcaacagaaacatgagaaaccctaacttacagtgtctcctcccctattttaaaagaaggaaatctgaaagtagagtcactgcaaaaatacatgcctcaccatatgcagtcatatttctgcaaccttcacccatgtattaagaggcaacaacaactactaggtaatacttttacttcaaatttgtacaatgaatcacaatttggtgtatcaagtgtgtcttaatgctttttagtagaatttcaaatctggttgaaataataattttagaaatgaaattaacaacaggtaaaattgaaatgcttagctaaaacaaaagcttcattcttctggtcaaaatgtttaaccctgccaaaataaataatgcctcatatttctgatggaatacttctgttggaacatatatggaatttctgcaaaagttttaaaagttaagagactaggtatagtggttcatgcctgtattcccagcactttgggaggccgaggcaggtggatcacttgaggtcaagagttccagactagcctggccaacatggtgaaaccccgtctctactaaaaatacaaaaatcagctgggcgtgatggcacatgcctgtaatcccagactagggtggctgaggcagaagaatcgcttgaaccctggaggcagaggttgcagggagccgagattgcgccactgcacttggcctgggagacagagcaagacttggtctcaagaaaaaaaaaatgttttttaagttgagagtatacaattaaagtcagtttcgcgtctgttctctttattgtaagcaaaagcttaattttagatcaaatacagccagatataggtaaaatttgcaccaaaaactatttaaaaaatctaggctgatatactaaatggtttctgtagcctagtgacaactttacaataaccacatgaagctagatgttctgagaagaatcccaaaatgtaaagaaaaattaggtgccagtggcaccactgaccggatgtgagaggcctccactggcagtgagacgctggcgggcatgctgaggttcccttgggggactgcaggtggaatgggtttttggggtcgacgaggtccacgccttctcttcttcttgtgttttttggttagtgcaggaggcttggtttttttcctgggtttcctctgctgctggtgctgaactttacgggagttatctcctctcaagaaattatcctttggaatgaataaataggcttttaaattgagattatctgggataaacctgacagctacctaaaaaatacttacatcccttaatattctatataatgcctaaaacatactggatgcccaaaactatgtataacaataatgaagacatcaaacttcatcaattccaagatctacattttaatatctctgcaattgggaagcattttaaattggtggcattttaccattgcggtcagcctgctgatggtcattatagttgacactgtctacacacacacacacacacacacacgcacacacacggttccagttctttgtactggcatcgtttctgaattaaggtttgtacactgttggtactacgtgtggaggaaaattttttgtgaatgtagaaaggcacaaagagcagcagggcataaaattaatattagtggagcacatattcattactgaagaaccgaccacaattcttttttttttttttccctgtaaggcaacaaccaagtgaaaaaggaaaataaccacaaagtagatgaagttgttctattgctgaagtacgtagaaaatactgcctttcacatgtcaagcagtacagccaaaaccaggaacagtatataaaaatctatgtctaaataagtcttttaaaagctctttaataagttgaaaacaaaaattctaagtgataagaaagtaccgcatcactggcaacattttttttctttcttattggcacataaaacagtgggatttgcaattgatgtcacctttaattaattccctaataactcttgtagctaaataaagattgtagaccatagtattttaagactaataactatcactagcatcaaaaaattgaaaacaagaaagaataaaattaaagcataaattcaggaaatctaaaacaggtttaatcctactcaaatgcttgaatgtaaacaattacagattaagtcacaaatacataaatttaaaacaaaccaaaaaaaagaggctacctctggccagacgcagtggctcacacctgtaatcccagcactttgggagccgaggtgggtggatcacctgaggtcaggagttcgagaccagcctggccaacatggcgaaactccatctctaataaaaatacaaaaattagccaggcctggtgacacgtgcatgtaatcctagctacttgggaggctgaggcaacggaattgcttgaacccgggaggcagaggttgcagtgagctgagattatgccattgcacttcagcctgggcaacaaaagcgaaactcagtctcaaaaaaaaaaaaaaaaaaggctacttctcagactctgtagttctttttgtctcaacacttgaggtctacttgtattatgtccactatttaactcaacaaatggtgaatgcgcaagggccagtacccgaacattgtgctcagcatccattccaggctttccctccagcaccagtgctgatctcaggaggaagttagggggctctcacccaagagaaaataagtcctatctgtaaggctcccaatgatcacctgggtcagattcctgcctgattctcctaagcttgtgtgcagtggccttgtggcactcttggtactatgccagatacttcacacagaacagcctgtgactgatacctgccttgctcgcctccagagagctagagcccccaccccctgaggctttcctaatgccagctgttcttttacctagcttcagtgcacagtgaaatactattcactcccaacttttgtctgattctacctctatgtcaaggcaatgcactcaccatctgtcataggatcttacaaaggtggaatcccatgttctgcctgacagccgggacttcctgcagctggagtctcttaccaatggctgtcacatcctagttctgaatcttaaccccttccattggtatgcctaaccattaatgtattcaacaattacttactgagcatctctgttctaagtgctagggatacagtagtaacaaaaaaatggtcctgcccttgtgaggtttacattctagtaggagaatacagaaaataaacaaactaatgaataactgttaggcagacaaatgttaggaagaaaaatgaggtagagtatgaggataaaacctgacagggtaacaggcaggtggaagacttgtgtgatgagacaacacatggtaacaaacctgaatgaaaggaaggagtgagcaatgcggaaacttgggaaaaggccaagtgtggtggctcatgcctataatcccaacactttgggaggcagtggcaggaggatgtgatgggaagccattagcaggttttgattttatggagctaatatgatcagatgtatagtctaaagggcctgctctaaaggctacttactacagaattccctttctatgacattctggaaaatacagaagtataggggcagaaaatagatcagtggggatggagtaaagggatgaccacaaagggagtagtgtaagagaatctggggagcagttctgtatcttgatttaggtggtggttatacaactgtatgcgtctacaaaactcctgagagtgtacactcaaaagtgaattcaattcaaagaaagtagaacatagacacacccagcctactctggctgctatgtaaacaacataccccctatggcagggggatatggcaagaagggagatcaattaggagactattacaataatccaggcaaagataatggtagcctcaactagaatggtagcagtgaaatttataaaatgtgtttggattcagaatataatatgaaaatagaggcttggcacagtggctcaggcctgtaagatcccagcactttgggaggccaaggtgggcagattacttgaggtcaggagctcaagaccaacctggccaacatggtaaaaccccatgtctaccaaaaaatacaaaaattaactgggcacggtggcacacgcctgcagtcccagctacttgggaggctactgtgggagaattccttgaacctgagagacagaggttgcagtgagccgagattgcaccactgcactcaaacctgggtgacaaagagagacttgtctcaaaaaaaaaaaaaaaaaaaaccagagcctagatttgcacatacttttcatctcccagtgtcagtctctcataggagcactgatggggtacaagtgcttcttatagtctcttatgtaatttttaacctaaaacaaaaatagctcaaactactgccagattctaactgtcttcagagagaaaaccattttcaaaaatttgtattttaaatacttgaaaaaaatttgattagtataattttgattgttatataaaatatatattattttatgactaatttacattatactaattcagtcttaggtttgcctcattgaatttgcctaagtaggaaagtttaactagctgaaaagaataaaactgcattcaatttctctaaaagcattcacataataatggttataggaggccaggcgcggtggcttacgcctgtaatcccagcactttgggaggccaaggtgggcggatcatgaggtcaggagatcgagatcttcctggctaacatggtgaaacctcatctctactaaaaatacaaaaattagccaggcgtggtggcaggcacctgtagtcccagttacttgggaggctgagacagaagaatggcgtgaacccgggaggtggagcttgcagtgagccgagatctcaccactgcactccagcctgggtgataaagcaagactccatctcaaaaaaaaaaaaaaaattgttataggaaccaaaaattcattcataataagttcctaaagcagacactgaagtacagttttttctacttaacagtatcttcctcagtatcttagaagtatgccggaatggtggaactttaaaatgaaaatatgcagctgggatcatttatttcgtgatttgaaagctacagggcccacattaccatgggtctgtgaaatcatcaatgaaggtccacaaaagtggttcaaaaagcatatagaaattattccttagctatgacaaagcctgagtaagcttaaaaaaaaaaaaaaaaaaagcctatattcgctgggcatggtggctcatgcctgtaatcccagcactttgggagaccaagccgggtggatcacctgaggtcaggagttcaagaccagcctggccaacatggaaaaacgctttctctactaaaaaaaacaaaaattaggcagcatggtggcatgcgcctgtaatccagctactcgggaggttgaggtgcaagaatcacttgaacccaggaggcggaggttgcagtgagccaagattgcaccactgcactccagcctgggtgacagagtaaaactccatctcaaaaaaaaaaaaaaaaacaacctatattttaaatgtttttatattaaagtgggaaaataattattcaacatttgtaatatgtaattgtaatatgtagtttagtatacaaatttttcaaaacatattgtctgtaaaagaaacctaaaaaataaaacaagttcttggtgaagaagccagttgatctggtttggttctgtgtccccacccaaatttcatcttgtagctcccataattcccacgtgttgtgggagggagacagtgggagatgactgaactatgggggcaggtctttcccctgttgttctcgtaatagtgaatgggtctcacagatctgatggctttaaaaatgggagttgccctgcacgagctctttttgcctgccaccatccatgtgagatgtgacttgtccctccttgccttctgccgtgattgtgaggcctccccagccacgtggaactgtgaatccaattaaacctctttttttttttaaattgcccagtctcaggtatgtctttatcagcagcacaaaaacagactaatatagcaaattggtaccagtagagtggggtgctgctgaaaagatacccaaaaatgtggaaccaactttggagctgggtaacaggcagaggctggaacagtttggagggctcagaagaagacagaaaaatgtgggaaagtttggaactcactggacacttgttgaatggctttgacaaaaatgctgatagtgatatggacaatgaaatccaggctgaggtggtctcagaaggagatgaggaacttgttgagaactggagcaaaggtgactcttgttatgttttagcaaagagactggcaacattttgcccctgccctaaagacttatggaactttgaacttgagagagatgatctagggtatctggcagaagaaatttctaagcagcaaagcattcaagaggtgacttgggtgctattagaagcattcagttttaaaagggaaatatagaataaaagtttggaaaatttgcagcctgacaatgcagtagaaaagaaaatcccactttctgagcagaaattcaatccagctgcagaaatttgcataattaacaaggagctgaatgttaatccccaagacaatggggaaaatgtctccagggcacgtcagatgtcttctcggcagcccctcccatcataggcctggaggcctaggaggaaaagatggtttcatgggccaaacccagggctcccgtgctctgtgcagcctaaggacttggtaccctgcattccaaccactccagccatggctaaaagggagcaaggtagagctcaggctgttgtttcagagggtggaagccccaagccttggcagcttctacatagtgttcagcctgcaagtgcacagaagtcaagaattgaggcttgggaacctccgcctagaatacagaagatgtatagaaacagtctgtctgggcatggtggctcacgcctgtaatctcagcactatgggaggctgaggcgggcagatcacctgaggtcaggagtttgagaccaccctggccaacatggtgaaaccctgtctctgctaaaaatacacacaaattagccaagcgtggtggcacacgcctgtaatcccagctacttgggaggctgaggcacaagaattgcttaaaccttgaaagcagaggttgcagtgagccaagatcaaaccactgcactgcagcctgggtgacagagtgagactctgtctccaaaaaaaaaaaatgtatagaaatgcctggatgcccaggcagaagtttgctgtaggagtggggccctccaggggaacctctgctagaatagtgcagaaggaaaatgtgggtgggagcctccacacagagtccctactgggacaccacctagtggagctgtgagaagagggccaccatcctccagaccccagaatggtagatctactgacagcttgcaccatgcacctggaaaagcagcagatactcaatgccagcccatgaaaacagccaggagaggggctataccctgcaaagtcacaggggcagacctgcccaagattatgggaacctatgttttgcatgagcttgacctggatgtgagacatgaagtcaaaggagatgattttggagcttttcgatttgattgtccactggatttcagacttgcatggagcctgtagcccctttgttttggccaatttctcccatttggaacagctgtatttacccaatggctgtacccccattgtatctaggaagtaactaacttgcttttgattttacaggctcataggcagaagagacttgccttgtctcagatgagactttggactgtggacttttgagttaatgctgaaacttttgagttaatgctgaaatgagctgagactttggaggactgttgggaaggcatgattacaatgtgaaggtattacaatgtgaagatatgctatttgggatgtgccagggcagaatgatacggtttgactctgtgtccccacccaaatctcatcttgtagctcccataattcccacgtgttgtgggagggacctggtgggagacgactgaattatggggcaggtctttcctgttgtctttcctgttgttcttgtaatagtgaatgggtctcatgtgatctgatggttttataaatgggagtcgccctacacaaactctatttttgcctgcctccatccatgtaagatatgacttactcctccttgccttccaccatgattttgaggcctccccagccacatagaactgtgagtccaattaaacctctttcttttgtaaactgcccagtctcaggtatgtctttcccagaggcatgaaaacggactaatacaccagtgaatcacacacattgagactgaggtccaaaaaggctgaatccttagcccctagttatataccaagctggtggcaaagccaggatcacaggttccaactattaagtcctggtctaatacccattccctcaccctgagaatccctgaaaactataacatgtttatagagggcaggaagtatctcactttctagtacataaggtacctaggaaagtatcttgcagtaactgcttgatggatgaaaacaataaaaatgaacttcctttaaatgattatataatttagatattcctcaaattcaaatctgtctctcctccaaattattctgaattaattaggatttatgataactagcattaactaaagcaataattacattcaatagatttctagaaaggctgggccttcgattgaagtttcatcaactattcatgacatttgtagaattgtatataagaaagcaaaaacttagagacataggaacaaagagagtatttagaaattctgctatgtataagatacatatcttaaggtaataaaatgtatcttaagggaataaaaatcctctctcaaaacttgtttcagtgatttatatacatacatagtttgtgctaagttataaaatacttcctacagtggatagctacaaaaagtttgaaagcctctgttgcagaacttaccatttttttggcatgttcttcacacagaggtgtctgatgtgtaatgtcaaaaactggcacagagcactgctgtccatctgcaaacttggctgtgcaacttgagaagagctgctgagagtggttcaagaggatatctgggtttttttaagttaggagtaaaatacactgaaactctaatttttcaatttctatataaaatttgcttgttcccttacatttcataagtacaagctttattatccataatataaatattacccatatcagtactagctcaactactgatatgggaaaataatagaatttatcagatgacaactctgaaggactctattttgctaatgagaccctggcaccagtctccttaatgaccattctgaaccaaattgtgttatttggaaaagcagggccatttccttcttaacatgtgaactccacttaaagttccacttcatgttttttttgttttgttttttgttttgagatgaagtcactctgttgcccaggctggagtgcaatggcacgatctcagctcactgccacctcggcctcccgggttcaagcaagtgattctcctgtctcagcctcccgagtaactgggattacaggcatctgtcaccacatccagataatttattgtatttttagtagagacagggtttcaccatattggccaggctggtctcgaactcctgacctcaagtgatctagccgcctcagcctcccaaagcgttgagattataggcataagccactgcacctggccaatggttttctttttttaaacagctcttaaaaggaaaattttctgcctatgatacttaccaagaataaaaatttaaagatatagttattagaaactcatctttccaaatttgaatattttgcttcacacttccagcaacaaactcaaactcacaacccatgaaaaattacttttaaatcaaaacttcactattggccaggcacagtggctcacacctatactcccagcactgtgggaggctaaggtgggttgatttattgagcctcagaagttcaggatcagcctgggcaacaaaaaagtacaaaaattagtcaggcatggtggtgcatgcctgtagtcccaggtactcaggaggctgtgatgcaaagatcacctgagcccagggaggtcgaggctgcagtgagctgtgatcgtgccactgcacttcagccggggtgacagagtgagatcctgcctctaaacaaacaaacatgagctttacatcatcaatatttttaagcactcatacttttagctactacatttccttaacacttaccttatatctattaagtgcctttgtgtttttcctttatggtttttaggtaaaactataaagcctttattacatagaaagtgctgctgaacaagctgttccaagaacagaaaggagggcaacaattaaatagatggtaaagataagtaattgctgctatttttacatgctacctgattttaaatactcaataaaagtcacagcaataagatttcatcaccaacctaaagctctttaacataggttttcttcaagtatactttaaaagagatcttctttcctaggcagtgatgtttgttacctttcattcatttcaaatcagcactgtactcattaaaaagagtaaactaatcttacaggaaaaagttctgtaaaactgtgtaactgtcttagaagactaaaaacagattttaaataatgtgatttgattttttccattaatgagtgttatagctccttcttacaagctactaggaaccacctgagggaccagaattctattaacaaaatataattaagtgacagacactggaggaacctgctatttgctatcaattttgcttattttttgtgatttttgagtaaaacaagaaaaattattcagaggacatcatgaaaattatgttcgataaaattattttaaacattaaacagttatggtttcaaaagtcattcacttgaattaaaaatgaaatatacagccccaaattaggtagtactttttcaatgcacattccatttagttgaaaggatacgttggaaacaatgtctggtgaatggaagggctttgttagcgcactgttcacccttcacggttccactgcatgctgctggttccacctccctcagcttggtccggcttatgctaaggaaagaaaaacagagaattaatttttttttaatgctttaagaatccagggtaatttttcaacatgatgtcacaactctgtaacactctcattataatatatataacatctacagtcactaaataaaatgcaaatgtgatttaaagaaagacggtattacaattaccaattgtgttatttccctaatcttctgacattcaaagctgataattacatcagaatatgtttcaagtatgtctgtttttttttttaagtgatgttttatttcccttttcttcacaaagagacagtagagaaaagtgatgaagaacatgagagaagaatcagatggacctggttttgaatctcagctctccctcttactagctgtgtgactatgggcatgttgctcagcctcatttaaaccccaattttctcacctgtaaagtagagacaataaggtaccttgagctggcagggttgttgggagcataaaaggattaatcacatctaaaccacttatatacagtatatagtattacacagtaaacagtcagtggttgttagtcatgactatgattatcgccaccattaggaattgattgcctcatgctactaaacccataaatctgcaaaaaaactcttcatctcatacatggggaagaggatactgatacgcagaaatggctgagtggcttttatcctccaaagtgaactcactttagatctattttttaaactttctattatatgtgcaatccatgtttcattatttaaatttttttttatctccactttgtacacttaatgtttaaatattttaactcatttaaaatcttatgaataagcaatgcattcacatggatccataaaaaaatgaaagaatgctaggcagtgaagaatcgacttcttgcccttgccccctaatttgccagcccccactccctctataatacgtattcattttattagtctgcagatccttccagtttctttacacaaacatataaaaacacaaataaataacatttaaattcttagaagtgggccaggtgcagtggttcatgactgtaatcccagcactttgggaggcagaggagggctcccaaaatcaaaaaggatcgcttgagcccaggagtttgagaccagtctgggcaacatagggagatccccatctctattgaaaaaaagaaaaagaaaaagaaaaaagacaattcttacaagtacaaaacctatcccatctacgtgactctataaagcatcacaaaccattaggcctttacaagtctgagtatgaggaaaaaaatctacttaacatactgagttcaagtcagatatcacaaacaaaaaatcttttgagttgtttgtttctagtatctttctcagggtttcaatggaattattgacactaattaggtaaggccacacagaatctaaattacatatgaatttacacaaaatataaatacttctaccgtagttattaatttcatataaactgtaaacactgtttatatgtccatggtgttgccttaaaacctgccttaactaagatgtctacaagatttgtcacgattataagaatagggaagtggatcatcatagaactaaacagtttattcctaatagtttatccattgtttctttaaaaaattgtttacattaaatttagccctataaaaggaatatataatttcaaataaataaacctttactattctggcagctaagctcaaattctcttggtctagatttaaatagaaaggtctccatattaaagggatacttctctttttttattttgagacggagttttgcttgttgcccaggctggagtgcaatggtgcgatctcgactcactgcaaccctcacctcccgggttcaggtgattcccctgcctcagcctcccaagtagctgggattacaggcacctgccaccatgccttgttaattttttatatttttagtagagacgtggtttcaccatgttggctgggctggtcttgaactcctgacctcaggtgatccacctgcctcagcctcccaaagtgctgggattactggcatgagtcaccacaccctgcctgaatggataattttcattaaacactctaataaaccgctcagctatcttcaaagactagtgtacaatacattccctcattttctttattccaaacttacaaaataactattggtttcattttttaaacttgccttgtttcaataaccccatggacaaattaaggtaaaaatggccagacacagtggctcacccagtaatcccagcactttgggaggctgaggcaggcggatcacaaggtcaggagttcgagaccagcctggccaacacagtgaaaccccgtctctactaaaaatacaaaaaaaattagctgggcatggtggcgggcacctgtaatcccagctactcgggaggctgaggtaggagaatcacttgaacccaggaggtggaggttgcagtgagccgagatcacaccattgcactccagcctgggcaacagagcagaactctgtctcaaaaaataaaaaataaaaaaaaattaatgtgaaaatgcttgatgtaatgttagatatattttattatccaaataagcccaacaaacaaagggaattaccaaaactttttcatgtttttcatatttaaaaaatctactacaggattccctttgacatgccctattgcaccccccataaataatgatgtttccatacaaacattagtcactgtatgattgtgggctgcaagatacttaatttgggttcacatatttgaagctatttcaatggcttattccacttactcatcaataaatacgacaaagttatttgataggaaagactaacattatttagcttgtatacaaactatattttattttattgagaaggagtctccctctgtcacccaggctggagtgcaatggtgcaatctcagctcactgcaagttctgcctcccgggttcaagcaattctcccacagcagcctcccaagtagctgagactacaggcgcatgccaccacacccagccaccatgcctggccaacgaactctattttaaaggatccaggccgggcgcagtggctcatgtttgtaatcccagcactttgggaggccaaggcaggcagagtacctgaggtcaggagttcgagaccagcttggccaacatggtgaaatcctgtctctacaaaaaatacaaaacaattagccagacgtggtaaagggtgcctgtaatcccagctacttgggaggttgaggcaggagaaccacttgaatccgggaggcggagcttgcagggagccaagacagcgccattgcactccagcctgggcaacaagagtgacactccatctcaaaaaactaaaaaattaataaagggtccacattagaaggtagccattaaacttttaatttctaaaatatgtaatgtcaaacttttatgtatctttttttgaaactaggactttaataccgaaaatatcaaatagagggcagcatgcaactaaaagttgacttttgtgaacctagaatataatgtaatataaaaagctgccggctgggcgcagtggctcatgcctgtaatcctaccactttgggaggccgggggaggcagatcacgaggtcaggagttcatgaccagcctagccaacatagtgaaaccccgtctccactaaaaatacaaaaaattagccgggcatagtggcgcatgcctgtagtcccagctacttgggaggctgagggagaagaattgcttgaacccaggaggtggaggttgtggtgagccaagactgtgtcaccacactccagcctgggcaacagagtgagactcatctaaaaaaaaaaaaaaaaaaaaaagttgccaatcaccaaagaatgattatgatacattgttacatgattatcagcgatgcactgggccataaacttttcactaatcatgggtgacacaactgaatatcatcaaatcaatctgaaaactataacagggtccatcttgctgtttgtttgttgtggcagttatcattaatgttttttaaatatcactgatgtcagttaggaagatgttctgaaaacaaccagttaagaatcatagatatatacagttttccacacaaataccaaattttcccaaactcattgtatagtcttttatatctttgacaagatcagaataatatattggactcagcatatacatttacatacaaattggttcatgctggacaattctactaaaagtatacacttgaaagcattatatcatataaatgttagttatcattattttataacctgtgtcaaactgagtaaattccttcaacaaatagagaacagaccttcatttattcaattttgttcactcgttcatcaatactggagatttaggaacaaactttttcctgttctcatggaaattactgtctagcatgagagacaagttaatataggtataaaattgtacaatgaaacagagtacagagcacagtaggcatacacagtagagggaacctaacatagtccagggaatcagggaatgtatctctaagaacataagtctctgagtaagctgagacctgaaggatgttctagaacagatactagatccagaggactgagaggtctaggagtcaggcaaggtgatttgggtgtaagggaagagtaggctgcagccattacatatggtatattagatacttcaaacaactctaacctgttctacttctagaaaactcttaagggcacagtgcatccatgtgagatatgcaactgaaaattaggtcactttattacaacaaatgaaaagcaaaatacacaacactaaaataaaatatcaaaaaacaggtatataagtaatatgaccaacagctacaaaataaaggttatattttaacactttgttttatttatttatctttttttttgtttgagacggagtctcactctgtcgcctagcctggaatgcagtggcacaatctcggctcactgcaacctctgcctcctgggttcaagcaattctcctgcctcagcctcccgagtagctgggactacaggtgcccaccaccacacccagctaatttttgtgtttttagtagagacaaggcttcactatgttggccaggctggtctcgaactcctgacctcatgatccgcccacctcggcctcccaaatcatgctgggattacaggcatgagccatcgcacccggccaacactttgttttaaaaccctttttttccctcaagtgacttatgatcattacataaaaatgagactgtacaaactaagaattttttcattttatcaataatcccaccacctagagatattctggtacataaattcctaaattttttctctatatatgtactaaaagttgtcatatgaaaatataataactggccacgcatggtagctcacgcctgtaatcccagcactttgggaggccgaggtgggtggatcacctgaggtcaggaattccagaccaggctggccaacatggcgaaactccatttctactaaaaatacaaaaattagccaagcgtggtggcgggtgcctgtagtccaagctactcaggaggctgaggcaggagaattgcttgaacccgggaggcagaggttgtagtgagccgagatcgcaccattgcactccagcctacacaagaagagtgaaactccatctcaaaaaaaaaaaaaaatatatatatatatatatatatatataaaataactaaaaagtgtgaaataggctggtccatatgcagtggttttacaagtaatttatcacaaccagttagttacagatttctttgctccttctccactcccactgcttcacttgactagccttaaaggaaaagaaattttttaaatgtgtgaaataataaataataaactcaataaagaagctggccttctatcaggaggctgaggctgtagtgacccgtgattacgccactgaattccagcctgggcgacagactgagaccttgtctgaacgacaacaaaaagaatcagaatttgaactctatttccttaaagtaagataatgttttgaaatttttttttttggaaggcagtcccactctgtcgcccaggctagagcacaatggtgtgatctctgctcactgcaacctcctactcccaggctaaagccatcctcccacctcaacgttcctagtagctaggactacaggtgcacgccaccacacctggctaatttttgtattttttagtagagatggggtctcatcacgttgtccaggctaatctcgaattcgtgacctcaagtgatctacccacctcagcctaccaaagtgctgggattacaggtgtgagccactgcacccagccatgttttgaaattttaaaattcaatttagtgctttaaatgtgtatttcagttaaaagtaataaccaggcaggggcagtggctcatgcctgtgatcccaggactttgggaggccaaggtgggcagatcacttgaggtcaggagttcaagaccagcctggccaacatggtgaaaccccatctttactaaaaatacaaaaattggcttggcatgatggcgggcacctgtaatcccagctacttgggaggctgagacagaagaattgcttgaaccagggaggcagaggttgccatgagccaagatcgtgccacttcactccagcctgggtgacagggcaaggctccgtctcaaaaaaaaattaaaaaaaagaaaaatagccataattaaaatatatataaaaaacaaaattgtgttaaatatgtatttatatatacacaacagatattatatatattttatatataacagatattttatatttatatatataacagaattccataatcagtttagaaaatataactttgtattttttaaaaattttataggtataaacaaaggtattactgtactaaggttttcaccattaccaccaaaatggtaatatgccaaatttctaaaatatcagataactctacatttctgatatacagattttcacgaatggaatattatgtaaacattataaatcctgttttcaaaagaatcttgaagaacatagggaaatggctatggtatacttttgagggaaaactagaaaactcaaattattgtcatgagaatgtcattaattaataattaagaattaatctcatgagaaagtggtcataattcagtgataaaaggaaaagagcatttacggaaataaatgaaaataatacagataacatgatttcaattttgctttttaatataaacacatggctcactggaaaatttacacacgcacgcgcgcacgcgcacacacacacacacacacacagagaaagactagaaggaaacagaatcaaaatgttaacagtgctcattctctctctcatgaatggtaacaagaagatttttcccttctcatttgtgtatttttaaaattttccacaataaacaagtatttgcattataaacagaaggaatttttttcttaaaaaaaattcaatgtaataaaatacttgcacaaataatctgtgaggtaatgtaaatattaatagaaaacacactgaaaaggccagctacagtggctaacacctctaatcccaacactttgggaggtaaaggtgggaggatcgcttcaggccaggagtttgagaccagcttgggcaatacagcgagaccctcacctctacaaaaaaaaatttttttaattagctgggtatggtttcacatgcctatagtcccagctactcaggaggctgaggtgggagggtcatttgagcccaggagtttgaggctgcagtgatctatgatcacaccactgcactccagcctgggcgacagagcaagaccctgtctctaaaaacaaaaaaatgaaaaccaacactgaaaagaaactaaaataacacatgtaaataaacataaaatactacttttgtagttaaaaatctataaatgttacttttaaataacatgaaatttctaagcattctatttttttaaagccaggtaacattctcaaatcttcaatgaataaattctaatcaaacttcagcaaaattttagtaatggtttaattttactgttagctcatggcagtattattttgccacctgtagcactttaataaagcaagaaaaccaaaacataatgcttaaacgtttaggacttagtggtcatctcccactgtgcctcaactatcctctcacaaaataaagaaagcaaactgagatgagtcccttaagaataggttgctgtggctctaacctggttcgactgcatgcagctctccgcagttcttgtattaactgaccagtgcattctggttctttactggccgcctgcagcaaagctttcctaaacgtatgccggcatttcttttgacgagattctgcccgctccaggcggcagaggtgcttatatttctgctgaaagtaagtgcaaagttgagtcaccctggagctcctactctccgcatcatcatcatctgacctggaaagtgcagggagagaaaggaaaaactgattacacattaggctcattttagacagggtaaacgagaattaggaaatgtagctgaatgcacaggtttaaaacttttgtggcatgtgagcacatacttcacacaattagagtaagagaattccaacagagctgaactaagtacagtatttcaacagtaaggacagagttaatccagtgttttcaaaaacagccttcttagcatggcatcagtagacacttaatataccagtgtcttctaaattttaagtgactagagacccctgaggaaaaaaattcatttctttacctttacttactaaaaagtctgagtaaatgacatgacagttatgaggaaacacatagcataatttcataaaagataggtcataccagaaatagggcagcgaattctaacagtttattatctaagagctgcccttttaaccattctggtttttaaccacctttttcttgctaaccacctaaagaaatttggttgtagggatcgcattaattctaccatgtatttttgttttgtttttttgttttttttttttggagacagagtctcactctgtcgcccaggctggagtgcagtgatgcgatctcagctcactgcaagctccatctcctgggttcacgccattctcctgcctcagcctcatgagtagctgggactacaggtgtctgccaccacgcctggctaatttttttgtatttttaatagagacggggtttcaccatgttagctaggatggtctcgatctcctgaccttgtcatccacctgtctcggcctcccaaagtgctgggattacaggcatgagccaccgagcccggccttctaccatgtatttttttaactatggaagtatcctaaacagcatttgataagtcagggattacataaaggattttccatcacatgctaataatgtgattaattggtgtcctggctgaaatgctatgtggaagtgatgctgaaggaacatctaagctcaacaagaaagagtgcctttttagcaatggctaccaccagcaaggtttaaaaggccacttttttatggaacaaatgtgatcttactttttaccgttaggaataatgcccactggacttgaaaactgacctgttattttagcttctttctctgctatcataagtaaataccacacatgacaccatggactatatattctcttactaatcttctactattcattgctgggtttctcttaagtgatattattcttctttccttcagcatagtctataacaggctactctataaacttctacttagtacctctcctaagaagcacattctcgtcagtatactttttactacagatctacaaattgaaggactttacttcaatcttttcatttattcaacattcaacattcactgtgtatctattatgctcagcactacagaagagagaccaacatttcaaagagtttgcaatgcaatttggacaagataaacacttcccaaaaagttaaaacaattcaaaaaagaataaaaacagtaacaaaaacagtggggcaaaaaggccaatgattcaaatatctgaccacaaatcagaaaaatctgtgagcacttaaaagtttcagactcctacaaactaccccaaatctactgaaccagaatctccatggtatagggcccaggattcttcattttgaatttttccctgacctctgacagcaggtctacacttgggagttctcgtagagctagcaaatgtgataaatatctttcacacaagacagaaaacagtaaagtaccacaacagaggtcagggtaaggtgttactgaagttcactggaaagacagctggaaggcctgggtacgatggctcacatctgtaatccctgcaattttgggaggccaaggtgggcagatcacctgaggtcaagagtttgaccaacaacgcaaaaccctgtctctactaaaaatacaaaaagtactcaggtgtagtggtgtattcctgtaatcccagtcactcaggagactgaggcaggagaatcatttgaacctgggaggtggaggttgcaggaaactgagaccacagcagtgcactccatcctgggtgacagagcaagactttgtctcaaaaaaaaaaaagactgctggaagtaaagaaaggctttgcagaggaggtgacagcagaaatgaaccctgaagaaagaggacctcacacaaatacaacacgtaagccaagacacacaagacacagagatagacaggatggtgaacagcaagaatgtaagtagcttggtgtggctaaggtaaggggtctgtaagggaataatgataggtaaggttagctttctagacttaaatgtcaaattaaagagtttaacctttattccacaggtaaagcagaagacttgtaattttttaaattttgcactcctaactgctaagctttgtaactgttaagaaaatacagtaacagaggtgtgccatgacaatgattacagtcagcagcagatataaaataaacagaagaagagagagaagaaggcagttaaaaaattactgtaaatctccagcaaagagataacaaggatccatgctaggatggaaggagcaggactggagagcatgaggcaatctgcatgtataaagacaagctttgtcagctggcaaggaccagagaagggacaataagcaggcagcagtttccaccaacaaagaatgggaaggacagtaacatcatgtataaaacaaggaactaaaaatacaaaaaaaatagcttggtatggtggtgcatccctgtagtcccagctacttgggaggctgaggcaggagaatcacttgaacccaggaggcagaggttgcagtgagccaagatcacgccagtgcactccagcctgggtgacagagcaagactccatctcgaaaaaaaagaaaaaaaaaaaagacatataagggccattatcataagtgaactaactcactttggtgactcaatatgaaagattagaaagtcaatgactcaatgacttagaatatgcataactaggaaaacagaagtctcattcatagaaaaaggaaatggagaggaaaggcagatcttaaagggaaggtaaagcttgggtcgataatcagttgccaaaactgttattttaaaaagatgcacctgcgcccctgccaccgctatcaccacctcagtgtcccttggctccagtcccactcttaggacagcaccgccactgctgcatggccctgcctgcctcctgtgctgcgcagcacttgcgggtgccccagatggcactttacccctaggactggcttaaaatagtggagtgatcatcatggccgatgagaggcaggactggattgcagctccaactcggacagacagagcagagtgccgaggcttgcatagtgaattttatctccagaacaactgcaagaacaaaccaggaatcccgagaggacctacagaccctctgaaggaagtggactgctcctgcaggatccggagacactccaaataccgtgagtgcccaaactgcggaagtaggaaagggagattctccgtttcgaacacacaccgctgctggggaaactgaaggtctagtttgcaggagaagtttccgaccttacctggagctgagtcaatttagagagctgagcaaaataacaggggtagagaaagcagcaggaaacgctctgggagctcactgggtccccaagcaggtcattcctgcctggcatcacagagatctttcgggagggcagccagaggcatggggaaaatgccacagggagaaggaaatctccagctgaactttgtaacaatttgaacctggcgagaagcctcctggccagaatgtggggaaggccacaaatcgtctgtgcagactccacaggtggggaaagaaccaaagcccctctcttttgcagctgggaggcaggtagcctcggacaagttctcaagccctgctcacccactgcctggaaacagactggggctattaggtggggcatggtgggagtgaaaccagcccctcagattgtgtgggagctgggtgaggcctatgactgccggatttcccccacttctctgacaacctgtgtgattcagcagaggcagccataatcctcctaaatacacaactccattgatctgggagcctttgcctagacacattgtcattaggttatccaaagttaagacgaaggaaagaatcttaagagctgtgagacagaagcaccagataacctataaagaaaacctgtgagattaacagcagatttctcaagagaaaccctacaagctagaagggattggggccctatcttcagcctccttaaacaaaacaattatcagccaagaattttgtatcaagcaaaactaagcatcatatatgaaggaaagatacagtcgtttttcagacaaacaaatgctgagagaattcaccatgaccaaaccaccactacaagaactgctaaaaggagctctaaatcttgaaacaaatccaggaaacacatcaaaacagaatctttttaaagcataaattatacaggacctataaaacaaaaatacaagttagaaagtgaaacaaaaaacaaaagtacacaggcaacaaagagcacaatgaaagcaacggtacctcatatttcaatactaacattgaatgtaaatgacctaaatgctccacttaaaagatacagaaccacagaatggataagaacccaccaaccaactatctgctgccttcaggagactcacctaacatataaggactcacataaacttaaaggcacagaaaaaggcattccatgcaaatggacaccaaaagcaagtaggggtagctattcttatatcagacaaaacaaactttaaagtaacagcagttaaaacagacaaagagggatattatataatagtaaaaggccttgtccagcaaccacagaataaacactctattcaacagtgcatggaactttctccaagatagaccatatgctagaccacaaaatgagcctcaataaatttaggaaaattgaaattatatcaagtatctctcagactacagtggaataaaactgggaatcaactccaaaacaaaccttcaaaaccatccaaatacatggaaattaaataacctgcccctgaaagagctttgggtcaaaaacacaatcaagatggaaaattaaaaattcttcagattgaatgacaataatgacacaacctatgaaaacctcttggatacagcaaaggcagtgctaagaggaaagttcatagccctaaacgcctacatcaaaaagactgaaaaagcacaaactgacattctaaggtcacacctcaaggaagtagagaaacaagaagaaactaaacccaaacccagcagaagaaaggaaataaccaatatcagagtagaactaaatgaaattgaaacaaacaaacaaaaaaatacaaaagataaatgaaacaaaaagctggttctttgaaaagacacatacaattgataggccattagcaagattaaccaagaaaagaagagagaaaatccaaataacctcaataagaaacaaaacaggagatgttacaactgatactactgaaatacaaaagatcattcaaggctactatgaacacctttatgtacataaactggaaaacctagaagagatggataaatggataaattcctggaaaaatataaccctcctagcttaaatcaagaattagataacctgaacagaccaacaacaagcagcatgattgaaatggtaatttaaaaattaccaacaaaaatcagtccaggatcagacttattcacagcagaattctaccagacattcaaagaagaattgataccaatccttttgacactattccacaagatagagaaagaaggaatcctccctacttcattctatgaagccagcatcaccctaataccaaaaccaggacataaccaaaaaagaaaaccacagaccgatatccctgatgaacatagatggtaaaacccttaacaaaatattacctaaccgaatccaacaacttatcaaaaagataattcaccatgatcaagtgggtttcataccagggatgcagagatggtttaacataagcaagtcaagaaatgcaatataccacataaacagaatcaaaaataaaaatcacatgatcatctcaatagatgcagaaaaagcatttgacaaaatccagcacctctttatgattaaaactttcagcaaaattggcatacaagggacatacctcaatataataaaagccatctataacaaacccacagccaacataatactgaatggggaaaagttgaaagcattccctctgagaactggaacaagacaaggatgcccactctcaccactcctcttcaacatagtactggaagtcctagccagagcaattagataagagaaagaaataaagggcatccaaatcagtaaagaggaagtcaaactgtcactgtttgctgatgatctgatcgtttacccttgaaaaccattaagactccagaaagctcctagaactgataaaagaattcagtaaagtgtccggatacaaggttaatatacaccaatcagtagctcttctatacaccaacagcaaccaaaatcaagaactcaatcccttttacaatagctgcaaaagaaaaataataataataaaatacttaggaatatacctaacaaaggaggcgaaagacctctacaaggaaaactacaaaacactgctgaaagaaatcatggatgacacgaacaaatggaaacacatcccatgctcatggacaggtagaatcaatattgtgaaaatgaccatactgccaaaagtaatctacaagttcaacataatccccatcaaaataccacctcattcttcacaaaattagaaaaaacaattctaaaattcataaggaaccaaaaagcagcccacatagccaacacaagactaagcaaaaagaacaaatctggaggcaacacactacctgatttcaaactatactataaggccacagtcaccaaaaaagcatggtattggtataaaaatgggcacacagaccaacgggacagaatagagaacccagaaataaactcaaatacttacatccaactaatctttgacaaagcaaacaaaaacaaagtggaaaaagaacaccctttcaacaaatggtgctgggataattggctagccacatgtaggagaatgaaaccggatcctctcaccttatacaaaaatcaactcaaggtcaattaaggacttaaatctaacacctgaaactataaaaattctaatactggaaaaaccttcctagacattggcttaggcaaggagttcatgaccaagaacccaaaagcaaatgcagtaaaaacaaagataaatagctgggacgtaattaaactaaagagcttttgcacagcaaaaggaacagtcagcagagtaaacagacaacccacagagtgggagaaactcttcacaatctattcatctgacaaacgactaatatccagaatccacaacgaacccagacaaatcagtaagaagaaaacaaacaatcccaataaaaagtgggctacggacatgaatagacaattcccaaaagaagataaacaaatgggcaacaaacatatgaaaaaatgctcaacatcactaattgcaaatttgatttgcagggaaatgcaaatcaaaaccacaatgcaataccatcttactcctgcaagaatggccataatcaaaaaatcaaaaatcagtagatgttggcatggatgtggtgatcagggaacacttctacactgctggtgggaatgtaaactagtacagccactatggaaaacagtgtggagattccttaaagaactaaaagtagaactaccatttgatccagcaatcccactaccgggtacccacccagaggaaaagaagtcattatgcaaaaaagatacttgcacacacatttatagtagcacaattcgcaactgcaaaatcatggaaccaacccaaatgcccatcagtcaacgagtggataaagaaactgtggtatatgatggaatactactcagccataaaaaggaatgaattaatggcatttgcagtgacctggatgagattggagactattattctaagtgaagtaactcagaaatggaaaaccaaacatcctatgttctcactgatatgtgggagctaagctatgaggacccaaaggcataagcaagatacactggactttggggacttggggggaagggtggaaggggagcaagggataaaagactacaaatagggtgcagtgaatactgatctcacaaatcaccactgaagagcttattcatgtaaccaaataccacctgtaccccaataacctatggaaaactgaaaaaataaaaaagatgctattactgcagaatggaaggactaaatcagtgcttctcaagttaagtgtggaaagacgcacttggatgctgaggcacgttacatgattatacgattttctaaagcttattcataatttccatacttattttatcacagaccagtaacaagcagtttgcagactgacacaggtccacagaccatcccttgcaaggacataatttagaacatcttcaggatgcttcccacttctaagatcaaggacattaatatttcaaacctggttgctgatgaagagtagagaattgagaagagaaaggccagtttcccttcatttagcagtgacaaaacctggcacctagtgcattctcagtttgtgtttgtttccttccttctttctttccatatctgtgaaatgagagatacacctggcctacctcccaaggttgtttacaaaaaaggaaagaaatgatacctgtgaagtaacaatataaatacagatattgttattactaagatgctattaataacccaaatacagagcagcaaattctacacttgatattctaagattccaggcttgtccataatctcaaggcatgccatgaacttctccaagggaaattcattttaatttactttattaagacaaccaaacagcaaaatggtaatacctctaataaaaacaggagaatcagaaagaggcatacatattaagaaaaataatgagtttagttttagaaatgctgaatttaaggtattgaccaaatacgtgatgagaaatatccaacgagcaattcaaactcaaaagaatcattagacatgagtaaaagatttgggagtcattcacaaaaagataacaagtaaacccagttagaatggctatcattaaaaagacactgttggtgggaatgtaattagtacagcctctatggaaaacagtataaagatttctcaaagaagtaaaaatagaactatagaacttccattcaacccagcaatcccattaccaggtatctacttaaaggaaagtaagtcaatgtatcaaaatgataccggcactcatatgttgataacagcactattcagaataacaaagaatggaatcaacctaagtgtccatcagtggacaaatggataaagaaaatgtgttgtatgtatacataatggaatgctatttagccaaaataaaaaaagaataaaatcatgtcttttgcagcaacatgtatagaattaggggcttattataagtgaaacaagccaggcacagaaagacaagtatcacatgttctcactcataagtgggtactaaaaaacatgttcacatagacgtagagaatggagtgatagacgatgaagactcagaagggtgacggggtggaagagcggaggataatgagaaattggttaacaggcacaatgtatgtcattcatgtgattggtaccctaaaagccctgacttgatcactacacaatctatgcataacaaaactgcatgtgtaccccataaatgtgtacaaataatatggaaataaaattactagtcatctgttgtattctattttgatctgtgtattagaatatttgtggtataaagatgaataaattgtgttctttgaccttgagggtaaaaagaggtacctgataaaacttttaaaagaaacacttaacagcatatggtagtttagatactctaacagaacttgttgccattctaaagcaacaatatactaggtaaaatatatgaatgcattgttggtcccaataggaagtagaggagatctcttcccctaactgctcatcaaaaagtaaataaacaataaatagaaaaaacttgggccaggcacagtggctcacgcttgtaatcctaacactttgggagaccgaggtgggaggatagcttaaacccaggagttcgaaagtggcctgggcaacatggtgaaacccatctctacaacaaaatgcaaaaatatagccaggcgtgctggtacacgcctgtaatcccagctactcgggaggctgaggttgcaggatggcttgagcctggaaggtcattccagcctgggtgacagagtgagaccctgtctcagaaaacaaacaaacaaatgaactcaaaactgaagctaaagttagaagcagagaaaaaaagagaggaggtaggctgatttcagagtacttgctgatataaagtatcatccaaacaagataatgtagctaaatttgagtttccagggtaagtccagaacctataaaaccaaagattaccatgcaaatgagtaggtaagccactttgtgtgacaaaaagaaaaaacacattaaatgatagactcatacttacaaagaccccgaaggtgggacttacgacatacagaatataaaagttgtgtaagaaaggtataaaggggctgggggcggtacctcaccccggtaatcccagcactttgggaggccaaggcgggcagatcacctgaggtcgggagttcaagaccatcctgaccaacatggaaaaaccccgtctctactaaaaatacgaaattagccaggcgtggtggcgcatgcctgtaatcccacctactcgggaggctgaggcaagagaatcacttgaacccaggaggcagacattgcggtgagccgagattgcgccattgtactccggcctgggcaacaaaagcaaaacgaaagtccatctcaaaaacaaaacaaaaaagaaacatataaacgatgttcctgctatagcttaggctcttggttctgggcttagtggcatggttccagaattttatttaataaataaactcttacaaataaaaaattatttgctgggtgcagtggctcacgcctataatcgcagcactttgggaggctgaggtgggggatcacctgaggttgggagttcgagaccagcctgaccaacatgtagaaagcccctctctactaaaaatacaaaattagctgggcgtggtggcgcatgcctgtaatcccagctactcgggaggctgaggcagaagaatcacttgaacccaggaggtggaggttgcagtgagccgagattgcaccactacactccagcctgggcaacagagtgagcctctgtctccaaaaaaaaaaaaaaaaaagaaagaaagaaagaaaaaatattataatggaatgttatttttaaaaactgtatgccaaaaacttagataaaaaatggacaagttcctagagaggcacaagcttctgaatctaactcaagaaaaaacatgaataaacatacgacaaagagtaatcacaaaacttcccacaaaaaaaagcccaggcccaggcgcggtgactcacacctgtaatcccagcactttgggaggccaaggtaggcagattacttgaggtcaggagttgaagaccagcctggccaacatggtaaaacctcatttctactaaaaatacaaaaattagccgggcgtagtggtgcatgcctgtaatcccagctactcaggaaactgacacaggagaattgcttgaactcaggaggtttagtgagcctaaatctcaccactgcactccagcctgggtgacagagtgcgactctgtctcaaaaaaaaaaaaaaaaaaagcccaagaccagatggcttcactagtgaattatactaaaacatttaaagaataactaacatgttagacgtaaatgcaataatagccttccttcctttttgttgtagccctcggtggttgctgtcaaaatgggcaagtgcatgaaacctgggaaagtggtgctggtcctggccagcagtattctggctgaacacaaagctgtcatcgtaaagaacattaatgatggcacctcagactgcccctacatccaagctctcgtggttggaattgatcgctatccctgcaaagtgacagctgccatgggcaaaaagaagattaccaggaggtcaaagatcgagtcttttgtgaaggtttataactacaatcatcttacgcctacagtgcactctgtggatatcctcttacacaaaactgtcatccacaaggatgtcttcagagatcctgctcttaaacacaagtcccaatgggaggccaaggtcaagctcaaagagagatacaaaacgggcaagaacaagcagttcttccagaagctacagttttagatgttttgtttccatcttaaaaattaaataaataaatgcagtaatataaataataacattaaattcaaatggtctaaacactccaaataaaaagcagacactgtcagagtagataaatgaaatgagtaggaatgaaaggacactgttatacgttcttatgcgtgaagtggtttaacacttgaaggtagactgtggtaattaaagatgtatgatataaaccctacaacagctactacaaaaacaaagcatatgagtacagctaataagctatgaaaagagataaaatacaaccataataaaacagggagaaaagaacaaagaataggtgagacaaatacaaaagacagtaaatttaaacccaataaatatcaataatcatattaaatttaagttgtctaaatactccaaataaaaagcagagattgtcagaagagatagaaaagcaagacccagtaatacattgccagtaagaaactcactttaaatataaagatgcaaataggttagaagcaaaaggactgaaaaagataccaagctttcactaatcaaaagaacgatggagtggctatgttaatgccacataaggaaagatctcaaagcaaacactgttactgggatatagaggaccattttataataataaaaggccacttcatcaaaacaatcttaaacaattatgcatctaataacagaaatacaaagtgtgggaaataaacaatgacagatccaaaaggagaaataatcaaatttacaaagagatatttcaagatccttttctcagtaattgatataacaagttgacaaacatcaccacagatgtagaagacatgaacaacactattaaccaacttgacctaatttacatttatagaatactatattcaaatgtggtttgtgatcacagaattaaactagaaatcagtatctgggaaaccccaaaatactcaaaaactaagtatcatttctaaatagcccatagatcaaacaagaaatcaaaagagatattacaaagtattttggggctgggcatggtggctcatgtctgtaatcatagcactttgggaggccaaggtgggaggatcacttgagcccaggagtttgggaccccatctttacaagaaaataaaaaaattaaaattagccaggtgtggtagcacacgcctatgatctcagtcactcaggaagctgacatgggtggatctcttaagccaggaggtcaaggctgcagttgagccgtaatcatgccactgcactccagcctggatgacagagtgaaaccttgtctcaaaaaaaagtatttttaactgaataaaaatgaaaatgtattaaaatttgtgggacacagctacaaccagtgtttagagggaagtgtataacatgaagagtcaatattagaaaacaataaagatctcagtcaactgacttaagctgtcaccttaaaaactacaaaaagacaagcaaattgcattcaaaacaagcagaaggaaataatgggaattagaacacaaagcaatgaaattaaaaacaataaagagaatcaaagaaaccaaaagcaatattaaaaggtggctcacgcctgtaatcctagcactttgggaggcggaggcaggtggatcacctgaggtcaggagtttgagaccagcctggccaacatggtgaaaccctgtctctactaaaaatagaaaagttagccaggcgtggtggctggcgcctgtaatcctgctactcgggaggctgaggctggagaatcacttgaactcggggggcggaggttgcagtgagccaaaatcgtgccattgcactccagcttgtacgacagagcgagactttgtctcaaaaaaaaaaaaaagcctttagggctgggtacagcagctcacgcctgtaatcccaatacttcggaaggtcaacgcaggaggactccttgaagcaaggagtttgagaccagcattggcaacatagtaagagcctatctctacaaaaatttaaaatggtggcctgcacctgttgtcccagctactcaggaggctgaggcaggaggatcacttgagcccaggaagtcaaggctgcagtgaactatgatctcaccactgcactcccgcctgggtgatagggtaagaccctgactcaaaacaaacaaacaaacaaattccttatggcacaatcctgcattaccaaaaaattcacaaaaagattctttaggcacaaatttggtggccagacaactgtcagttttcttttaaaaactcaatgaacttattgaggcatttggcatggcaacaccctcttgaagatataatgaacagcctaggtagggccaattttcttttctttccttttcttttttgagacagactctcactctgttgcccaggctagggtgcagtggcacaatctcggctcactgcaacctctgcctcccgcgttcaagcaattcttctgcctcagcctcctgagtagctgggattacaggtgtgcaccaccacacccgattaatttttgtgtttttagtagagatggggtttcaccatgttggtaaggctggtctcgaactcctgacctcatgatccgcccacttcggcctcccaaagtgctgggattacaggcgtgaactaccgtgctcagccaggtagggccaattttcatttcttttccttttttttgagatggagtctcgctctgtcatccaggctggagtgcagtggcacgatctcggctcactgcaagctccgcctcccaggttcacgccattctcctgcctcagcctcccaagtagctgggactacaggcacccgccaccaggcccagctaattttttctatttttagtagagacggggtttcaccgcgttagccaggatggtctcaatctcctgaccttgtgatccgcctgcctcggcctcccaaagtgctgggattacaggcgtgacgactgtgcctggccgaggtagggccaattttctacagctccccattttctactacactgaaacacagcaaggtacaacaaatgacaggtagctgcaacaagaaattggaataaagatggaagtttaaaatgcaggacaggtcaggcatggtcgctcatgcctataatcctgacactttgggaggctaaggcaggaagatcccttcagaccaggagttccagaccagcctgggtaaacataacaggaccccatctctacaaaaaacttaaaaattagccaaatgtggtggtgcacacctgtagttccagctactcgggaggctgtggcaggaggattgtttgagcctgggagttcaagactgcagtgagctgtgatcatgccactgcactctactgtgggcaacagcaagactctcgtctcaaagaattaattaattaattaattaaaatacaggacagagattcctcttagagggcagagtggcagatacaaatgtggagttacaggaatagatgggtgggtaaaccaacatgtttgcccaacattaaaaatatacagtgctccctgactggagcataatagcccaacaagaaagtgctgaataagtaaatgaacaaatgaatgaaaaatgaatgactgagtgaaggaaaagaatgaaggggaaaagatggaaacagcagctgggcaagaagtaaggataaatacctgttaaaaaaaaaaaaaaaaaaaggaggaaaacagagtaaaggaaaagaaccaggggagcagagtatcgtagtaatcaaagaggaagcaagttatgaaagtggccaagaaagtaacatgctacagagataaagaaaaatgaggatggccacaaatctgaaacaacaaaagaagtattttgataactctgcaagaatagaaggcagaatagaatacacattgttcctaatcaatagcatatactccctatactgatgtcaaggttaccttaagaattaaattaagaatgataactaccatttattaataatttcccatgtaccaggttttggctggatttgtaaaattaacccaaaatatcacaagtcaaattaagctgatacgaattaccattaggaagtatgactgatggtatctataactaaaaagcttaagctcaattgactctattgtgctgtatctgaaagaacctgctaatggtaaggtaaggaaacagtcttgaatgacatataaaatggaacctcagtgtaagaaaaaaaggtataacattctccaatactatctagggggtaagtgaggaacaactgggtgggagataaatccaaagagtggaatagatacatcatgctattataatttaagacagtgaccactaataaaatccaactaaccctacttgctctaattccatgtccaaataagcttctgatgataatttgcttcctgtgtagttttgtttagtgaccatttgtactatttgatgattgtatttctcattataagctggcattttagtgtacagattagtctctagtgaatcagttccctaagcctaatcacctctaggtatactaacaaatcacatttttaatcctataaactcaaaaaccatcacagatagctgatctccctctacattgctgaatatctattcaaaccacaacattttaaataaatggttagctgagtaagtgagtcatcttttggtagacaaggatctatcttggtattgtcaaactgtaccaagtgaatctgtagaatgctaaaaggagtctcctaaaaaaattcattttcttactatcattgaagaggatgtgcattcaacttctacagatcttagacaaacacttcttttccgaagacataacatggggaaaaaaactgaagagagctgtcagtataccccgacagctttccaataaggaaggtacaaagaaaacccctcaggagatctagcctaaaaaaaaaaaaaattgtagcacagtagaaataaagaatggatcaatgttgcagaagatagaggtgaagtaaaaaagcactatttctactactgtggagatgtacagccaaggaagatacagagaggcaagatagtgggactccacgtagccccccaagggaccacgtgcaagttcctcaacctatgtgggccttgctttcctcttctgtaaaatgaggaaattggatcaattaatctctaaggttcttttcaattctaggttctattataattaattcctttaatgatgaatgggaaaggtacagaagcaaatttaccaagaaaatttaagagtagctttgctcaaacgatatagtacatttacaaacaatatagtacatttactcccaagtggaatctattttaccaccaattttttagagtgaagtctttttttacctttattttacaataaaactagatctaataacataaaagtatcagcatatatagtgggaaatatcaatctgctacagtggtcattcaagaaggaaactagggccgggcgtggtagctcatgcctgtaatcctagcactttgggaggcctaggcggagagatcacttgagatcaggagttcaaaaccagcctggccaacatggtgaaaccccatctctactaaaaatacaaaaaaaattagtcaggcttggtggcagtaagctgagatcacaccactgcactccagcctgggtgacagagcgagactccgtctcaaaaaaaaaagaataaaaacagaacagaagacttacgcatgtctttgatatctgagggtttcccggatggaccatgcaacctggtagggcgaggcctgctctgagtcctctggttcctctccgctctcttcagaccagtccaaacctgggttagacaggagatattgcaaattagaaaaagtttacttttattcaaaatttaaactaaaaagctacacaaaataacataacccaacatacctattgcaagtactatcatggtgtgaataaatgtctcctgatgaatctcatttctattcttacaaagataatcggtttgtttttgtttttgtttgacagagtctcactctgtcacccaggctggagtgcagtggcacgatcttggctcactgcaacctctgcctcccgggttcagcgattctcctgtctcggcctcccgagtagccaggactacacgcgccagccaccacacccagctaatttttgtatttttagtagagacagggtttcaccatattggccaggctgctcttgaacgcctgacctcgtgatccacccacctcggcctcccaaagtgttgggattacaggcgtgagccaccgcctggccacacaatcgggtttttaaaatgacattacaacaaaaaggctaagctatattccacagatgaacttcttttgtcagacacttcactaatggggtagaaacaacacaagtaaagagagatttcaggtcacaaaaaggcagaatttcttttctttttttttgagacagggtcttgctctgtcacctaggctggagcacagtgtggcatgatctcggctcactgcaacctctgccttccaggttcaagtgattctcatgcctcagcctcccaagtagctggtattacaggtgagcaccaccacgcccagctaatttttgtatttttagtagagatggggtttcgccatgttggccaggctggtctcaatctcctgaccttaagtgatccacctgcctcggcctcccaaagtgctgggattacaggcgtgagccaccacatctggccagaatttaagtatcaaaacttaatacactaaaatgatgtcagaaaaacataaaatacaaacaagagggtgagaaaagaagctcgatatatgttaaggcaagaaaaaggtcaatacctgcttctgaatggttttatgaaaacaacaaaaaaaaaaaatcaaaaagtgcagatagagtcactctacatttcaacaacgaagggccctatgataaagtgtcaaaggtagaaacactccatccccctctcccaaaccattccctggctcttaccttccatgggaagatggaagggtaggatggtaatgttctactactaatgaggtttcggatttctttcaattttttttttttgagacggagtctcgctctgtcgcccaggctggagtgcagtggcgtgatctctgctcattgcaagctccgcctcctgggttcacgccattctcctgcctcagcctcccgagtagctgggactacaggcacccgccaccgcgcctggctaatttttttttttgtatttttagtagagacggggtttcaccgtgctagccaggatggtctcgatctcctgaccttgtgatccacccgccttggcctcccaaagtgctgggattacaggcgtgagccaccgtgcccagcctctttcaattattttaaacaaaaaatgtcagactttgtgctccattatctaaaacaaggttagaaggaaaagtggatacagtatttattaatattttgttaaagggtctcgatctgttgcccaggttggagtgtagtggtgcaatctcagctcactacagccttgacctcccgggctcaagtgatcctcccacctcagcctccaaagtagctggcactacagacagcaccaccatgcccagctaatctttgtactttttgtagagaccgggttttgccatgttgaccaggctgctctcgaactcctgagctcaaatgatctacctgccttagcctcccaaagtgctgcaattacatgcatgagccactgtgcccagccaaatgctataatttttaatgactgaataatttttagctcctgccataaaagttttacccttttaaaagtcttgtatcttggccaggtgcaccggctcatgcttgtaatcccagcagtttgggacactgagccaaggggatcactttaggcaagaagttagagaccagcctgggtaacacaccaagaccccgactctacaacaaacttaaaaattagccaggctgagtggtgcatgcctgcagtcccaactattcaggagactgaggcaggaggatcgactgacccttgagcccaggaggttgaggctgcagtgagccatgatcatgtaactgcatttcagcctggtgacagagcaaggccctgtctctaaaagttaagaaaaaaagttttatatcttgaagaggtcttgataaagactgatgttgcacagcctaaagtgtaacagtatgtgggactatgtaagtttaatatatccatacctctatgaaacttactagacaccttgataactagtattttatttatgtcttccttcttgagaacctcaaaaatcaagagtatcctcattagacagttacattaaaaaggacttcatggattgcttccatagtttaaatgagtttacatgtgccaaatagggaaattaagaaaaggttaattaaaatgcaaattatgaatgcttaagattaaataacacattgccattggcataaagaaacttcaaatctaattctaagatgactatctaaaatgtcaggtcacctttaaaaatgagttactttctcaactgaaataattaataatttgtagggggaaaaggtaaaaaagcaattaaatgatcacagcatcaacttcagtgtgttgaaaggtaaggtccttcaaagtgacatttaaggcaccactgaaaaacagaacatgagttatcttttatttgtttcaatagaataatttctcctaagacacctctgaggtgtcttgactttctctgaggaagtcaagatctaagtcataaaaactaagacggaagtgtttttcctgctgtgaaactaactgtccaataaagcaaacctttgatcttggcttcattatcactagttttaatgtaactagctgacataactagcccagacaggactataaaggctaataataagactgagtttttatttaaatactctttgctgacatgaatacagactacactctgtcataagattacagagtatatgcattactatttctggtttccccaaagtaacttttgctttgaaatcttaggcctctaatatgtttgcattttaaaaaatttaaaagggcgtccgggcatggtggctcacgcctgtaatcccagcactttgggaggccaaggcgggtggatcacctgaggtcaggagttcaagaccagcctggccaacgtggtgaaaccccatctctactaaaaatacaaaaaatgagccaggcgtggtggtatgcacctgtaatcctagctactcaggaggctgaggcaagagaatcacttgaagctgggaggcagaggttgcaatgagctgagatcacaccacggcactccagcctgggcaacacagcgagactctatctcaaaaaaagaaaaaaaaaatttaaaaggctgaaaactttttctgtgtgttttcattctgtttaaaaatgatttaaaaattgctgggcacagtggctcatgcctgtaatcccagcactttgggaagccgaggcgggcagatcacaagattaggagttcaagaccagcctggccaatatactgaaaccccgtctctactaaaaatgcaaaaaattagctggatgtggtagcatgcgcctgtagtcccagctactcaggaggctgaggcaggagaatcgcttgaacccgggaggcggaggttgcagtgagccgagacctcgccactgcattgcagcctgggtgacagagcaggactccgtctcaaaagaaaaaaaaaaaaaaaaaaaaaaaaaaaagattaaaaaatcagcccctaagatgacataatatttcatcatttcaaaagctaaaaaattatcagcatccagaaataaatgaaattataaataaaaatttagtagatgatgccggtaagtgttggaattagaggcaaacattttttaaaaattgttatatttcgccgggcgcggtggctcacgcctgtaatcccagcactttgggaggccgaggcgggcggatcacgaggtcaggagattgagaccatcttggctaacacggtgaaacccccgtctctactaaaaacacaaaaaattagctgggcgtggtcgcgggcgcctgtagtcccaactactcggcaggctgaagcaggagaatggcgtgaacccgggaggcggagcttgcagtgagccgagatcccgccactgcactacagcccgggtgacagagcgaaactccgtctcaacaacaacaacaaaaatttcttagatctctgcctcaaaactaatgtctaaatgagttccagctagataaaatgtaaataatgaaatgataaaaggactaaaagaaaatacgggtgaatatgttcatatattcttgggatgaagagaatccaaataagcaagcaaaccaaaacccagactcaaaagaaagaaatcttaaagaagagaatacataaaaattttaacttttaaattcctacaatggatatttcttttcttttcttttcttttttttttcagagacggggtctcagctctgtcgcagtggcatgattatagctcactgccagtcataagctcttggacttaagggatccttccgcctcagcctcccaagtagcagagattacaagtttgcaactgtgcctggctataacagatacccggaagcaaaaaacaaaggagaggagggagagactttccaacaaatataatatacatataaaaagctcttaccaatcaatagaaaataaatatatggatggaagaagtgaaaggcaaaataaacaaaatgtccaaaaatcatatgaacgaatactcaactatattattaatccaaaatagcagttctgaaagtatggtccacagatccccagaagtccttgaaatattcttggagtatataggtcaacactatattctttctaagaagtttttttttttaatttaaattttaaaaaagagaatctcactatgtttcccaggctggtcccgaactcctgggctcacgtgatcctcctgtcttggcctcccaaagtggtaagattactggcatgagccacctcgcctggcctcaaaactattttcaacaaaataatattaaaacattatgtgcctttttcactgtgttgacacactgatggtataaaagcaatgacaggtaaaactacaggctccttaattaccatgaatcaaggcagtggcatcagacttactaggagtcattgtattcctcatgccatgcctcgcagttgtaaaggagttttatttgagaatattcttgtttgttaaagattatttatttttattaaatcgatccctgagcacatgtctttatactattctgtgtgagtaaatgtgaatctgctgcaaaggaagaaagcatgacagctgtcctgaggaagaggacttacacaactgtttttattgcaacctgaccaaactgctttttctcattcatcatcatttttttgtttttgagatggagtctcactctgtagcccaggctggagtccagtggtgcgatctcggctcactgcaacctccgcttcccgggtcccagttcaagcaattctcctgcctcagcctcccaagttgctgggattacaggcacgctccaccacgcccagctaagtttttgtatttttagtagagacggggtttcaccatgttggccaagctggacttgaactcctgatctcgtgatccacccgcctcagcctcccaaagtgttgggattacaggtgtgagccaccacacccagccttcatcatcatttttatttgaaagagaatctgacaggccaggcacagtgacttgtgcctgtaatcccagaactttgggaggccaagacaggaggatcagcctgggcaacatagtgagaccccatctctatcaaaaaatctgaaaaaaaaattagccagttgtggtagtgtgtgcctatggtcccagtgacttgggaagctgaggtgggaggatcacttgagcccagcaggtcaaggcagcagtgagccatgatcatgccactgcactctagcctgggcaacagagcaagaacctgtctcaaaaaaaaaaaaaattatattttaaatttatcagttttagcttctaatacagtataaatagatacaacccatacataagagctttatggtttccttattaatttttaagtgtaaaggatcctaaaaccaaatatttgagaaacactaatctaagatatgtaaatttaagcagattttctatctaatttgcaaaggcaataataacaataatactactacccagggctgataaagatttagagaaactgttattttcacacactgcttaaagaagataagctgacaaaataattctgaaggaaaatttggcaacatatatcaaaacttttttttttttaaaagctaaagcttggaatcggcaattccacttttagtctgaattaacaatctatttgaagaaaaaaagatgtggcaataattgttttactgcaaggctatatacatctacgacagtttataaggacataagctggatacaacttaaatggaagacagaattcagccatgacaaattacactgcatatgaaaaattaccaacttgaaaatacattagtatgaaaaattttaaaccaggttacaaaacagcatgtatagtaagagcccaattttatatattagaaagaatatatcaaggtattaacaaatgggtattaatatggcttggagtgttttaatttattatttttgtttataaattttttaacttttgtattttaatcacgaaaagtcacagatggtttaacaacaggtgaaacaataaaaagctataagaaaagccaccactcccaactcctataaaatataccctgtccaattccatcctccctagggtagctgatgttaacagtctggaagtatatatccttttatacttttacctttgctcacatcaatcaggccaatagccatatacttaatcaataaatatattgatatcccctgtttatttactttgtttatttttaccaaaatgggataataattacctcttgatttcttttttccactttttaatataccatggacacatcccggtcaaaagatacagaattttttttttttttgagatggagtttcgctcttgttgcccaagctggagtacaatggcacaatctccgctcactgcaacctccgcctcctgggttcaagcaattctcctgcctcagcctcccaagtagctgggattacaggcgcacaccaccatgcctagctaattttcgtatttttagtagagacagggttttgccatattggccaggctggtctcgaactcctgacctcaggtgattcaccggcctcagcctctcaaagtgctgggattacaggcatgagccaccacacctggcctcattcattctttttaatagctatataatatttcttttcttttcttttttttttttttatacaatagagacaaggtcttactgtgtcgcccagattggtcttgaactcctgagctcaagtgatcctcccacctcggcctcccaaagtgctaggattataggtatgagccactgcacccagcctgctacataatatttcataaaacttatatgaacaataatttagtcaaggtttcctatcagtaattgtttctttgcaggtttttaatgctgcaaacaatgtttcagtgaacatccttgcacatatatccttacattttgatttttttaatccacaggatagtgtcccaaaagtgagtctgctggctacaaatatattttgtttgtttgtctgagacagggtctcgctctgtcacccaggctggagtgcagtggcacaatctcggctcactgcagcctccacctcccaggttcacgcaattctcccacctcagcctctcaaatagctgggacttcaggtatgcaccaccacacccggctattttttgcatttttagtagggacagggtttcaccatgttggccaggctagtctccaattcctgacctcaggtgatctgcccacctcagcctcccaaagtgctgggattacaggcgtgagctaccacacccggcctatttttgtttttttagagacaggatctcactatgttgcctaagctggtctcaaacctctggcttcaagtgatccttctgcatcagcctctcaaagtaatgagattacaggcataagccactaagcccagcctatacatatattttaaattagtagatattgctaaattactcaccagcaatgtatgagataccatatcctgaccctgaccaacaatggatatcatttttcacaatctggtaattcattgttgctttaatttgtatttcctgcctgctgagaggattgaggtattcatttgtttattgactattcatatctcttcacgttctatctttgctcatatttctattgctgtcatattatgcaaataatttttcctgaagtgaaaatcatagctcatattgcattcgagaataaatttcaactgaattaaaggtttaaatgatcaaaaccaatcaaactattaatagaaaacatagaatatctgtataaacttggaatcgaggaagttttcttaagcaaaacaggaaattcagaagcaacaaaagaaaaatagacatgtgactacattaaattacaagttttccctgtattttctcactcttaaatcattaacaggtattgccttgagaattttttaaacaggaaaaaatgttttaaaactgtcagcagatatcaacaatgctatgatcattcctagaataagacacaccaagaacttcactagatgcacaggtgttaaactcataaaagcatacaaccaaacacaactgccttttaatgctgctatcactacaaataaaagctgcgtgtggaattctaaattcccaactcctatttctgtatcctattcagcaagtgttacaccctccagtgttggccctctgtatccatgggatccacatctgtggattcagccaattgctgatcagaaatatttgagaaaaaagattccatttgtactgaacatatacagactttttttcttgtcattattccctaaacaatacattataacaactgttttcatagcatttacattatatcaggtattatacgtaatctagagatgatttaaagaatatgggagaatgtacataggttatgtgcaaatactatgctgttttatatcaggatcttgagtatcctcaaattttagtgcctgagggaagacctggaaccaatccaccacacatgtagagggacgactgtgtttattttaaggtggtctacctaaatacagaatctttcactgcaccactctgcctcattgtgattccacccccatcacatatggggtaattatgaaagggaagctccacacaaccgaacacattttgtcatattatgtgtctatgatacgataaaatagataactcacctaaatggggaaacagatcagtgtccaactgatgtttctgggtgcacagtttcaccagtctctgcagtcggcttatacatgagaagtgtggagagaaggctgtggctttcatgaggatccggtcagtcctgggtgggtccacagtgggagccctactggatggcaggaggggcagaggcctcttgtgagacaactgccgtgcttgtgctatagtgtgtgtggtgggtgccactccctgcattggtaggctggtgttctgaggttgaggtgacttgcagactgaaccctgcggtggcgctggaggttttaaagaagtagataaaggtgacaggtgggagtgctgctgcggaggctgctgctgtgaaggtgcaggagggggactaaagtgctcttgtcgaacttttaaaatctctgtctctctctggcgctgccgattctgggccaacttgctctgcaacttctttctcacagttgcccctttctttaggtcatcatcttcctcattgaaagcaaatgggtcttccaattcggtttccaggtagtggagagggacccttgccccaggtggagagagggacattccatccagtccgttgggcatcttcaaggccaacgtgggcactgtcaggctaaaggccatggtatccatctggtgcctgaccttcacctcatctataggatcattctttttcttcctctcttttttcgggataaagccaagtacctgcaagtggctgttgcagtacctttaaaatacacacatacatgggaaaacagtcatgatacatattttttaaaagtagaacataaaactacatgagaatcctaatgttaaaaattgcgtcactatagtgactcttggcagccagcaacttaacatgcaaacctctactactttcaagcagtcctcaaagtcagtgtaattttgatgaggcaaatatgtgaactgtacatgcacaggggtggccagacagaagcaagtcattcagttactgagtggccctggataactgctcagctactgcttctcacatggctttgttattctctattcatagcatacaaagtaactcatcaagagtctaaaagatcacttaaaattctcttatgagaaaaaatatatatattttctaatgccattaaagtattcggagattcacaaagctcttatgacataaaaccctcaagaatgtcaagtgtctactgtgctttagacacatatacagagagagacagagaaagagagagagaatgaaataagaaagtaaaagatggttcgtggggttataggtgaaatgcctttttcaatagccagatgtaagtacatgaattatctcctgtagtacctacctgcagtaggcgctaaaataattcccttaatgcagatgaggaaactaagctttacagaaattgatgaacttgcctgagactctttccagctggaaagagtcagagctaagaccaactaaaatcaaagctcatgaagactctcattagtcttcaacaataagcaagtatactgcttgggtgatggttgcaccaggatctcacaaatcaccactaaagaacttgctcatgtagccaaataccacctgtacctcaataactttaaaataaaataataaaaactaataattttaaaaatgctttatagaattcaccagtgatgccatctgacatggacttttcctgtggaaagtttaaaaaaaaaaaaaaagagcaaaattaaattcaaaactgctattttgaattctctgtctgaaagatcacatatctctgtttttccagaactggtccttggtgccttatgtatttcatttgttgatgtcatgttttcctggatggtcttgaagcttgtgaattttcgtctgtgtgggcattgaaaagttaggtatttattgttgtcttcacactcttcatgctattttaaaaacctataaaggccgggcacaatggctcatgcctgtaatcccagcactttgggaggctgaggcggcggaccacaaggtcaggagatcgagactatcctggctaatccggtgaaaccccgtctctattaaaaatacaaaaaattagccgggcgtggtggcaggagcctgtagtcccagctactcgggaggctgaggcaggagaatggcgcgaaccccggaggcagagcttgcagtgagccgagatggtgccactgcactccagcccaggtgagagtgccagactctgtctcaaaaaaaaaaaaaaaaaaaaaaaacctataaaagggccgggcgcagtggctcacgcctgtaatcccagcactttgggaggccaagacaggtggatcacctgaggccaggagttcgagaccagcttggccaacatggtgaaaccccatctctactaaaaatacaaaaatcagccagatatgatggtagatgcctgtaatcccagctactcaggaggctgaggtacaagaatcgcttgaacccgggggcagaggttgcagtgagctgagactgcaccactgcattccagcctgagagacagagcaagactcgtctcaaaaaacaaacaacaaaaaaaaacagtactccatgcttaaataaatttggaaaatgctggcttaaacaaaattaaagaatgattttgttgttttttgttactgatgtgcaactactcaaagcactttgtgtaacatgcattatgaagttccaagaggaaactgtacccatctggcagtgtttcccaaagttatttgaaaatgaaacccagggccaaatgtggtggctcatgtctgtaatcccagcactttgggaggctgaggcaggaggatcccttgaggccaggagttcaagatcgacctgagcaacatagcaagaccctgtctcagttaaaaaaaaaaaaaaaaaaatcaaagaaaacagaaccagccgggcaaagtggctcatgcttgtaatcccagcactttgggaggccaaggtgggtggatcacctgaggtcagtagtttgagaccagcctggccaacgtggtgaaaccctgtctctactaaaaatacaaaaattagccgggtgtggtggtgtgcgcctgtaattccagctacttgggaagctgaggcagcaaaatcccttgaacccatgaggtagaggctgcagtgagccgagactgtgccactgcactccagcctgggcaacagagtgagactcagcctcaaaaaacaaaaaaaacaaaaaagaacagagaacctatttttactgtagcatataggtgatagctccaaaaaacatagtttgggaaaagaccactgaggtaaaaaatgtcaatcctcaaattcactgggcttcatcatataagtgtttttctagtaattgctaaaaatacagattcaccaaataatcagaaaatctcaagcacacacagaatatgtgtgggtgtgttttgttgcttcgtcttagaaataaatctatcagaggcactctttaacgtaggcctcttaagaaaaagctttctttgtcatgtgcagtcactgaaaaagcgaaaaaggtttctagccagcaaagagaatctacaccgtgtgtgtgtgtgtctgtgtgtctgtgtgcttccctagcaggtttgagctaggtcccatatatatcttaaacagaacagattcacaaagcaatggccagcaaagaaagaggcgtctgggataactgcactaaccaaaaagtttcccaagaacaagaaaaaattttaataaagaataaatttggcctggcgtggtggctcatgtctataatcccaacactttgggaggccaaggcagggcgattgcttgaagcctggagttcgaaacaagcctgggcaacctagtaaggatccatctccacaaaaagttttcaaaactcggccagccacgtggcttgtgcctgtagtcctagttactcgggagactgaggcaagaggatcatttgaggcccaaagttcaaggctgtagtgagctacgatcatgccactgcactccagcctgggcagcagaatgagaccccatctcaaagaaaaaaaagaaaagaaagacaaatttataacttagtacttatggccgggcgcagtggagcatgcctgtaatcccagcactttgggaggcagaggtaggaggatcacttcaggtcaggagttcgagaccagcctggccaacatggtgaaaccccatctctactaaaaatacaaaaattagccgagcgtggtagtgtgcacctgtaatcccagctactggggaggctggtgcaggagaattgcttgaatcaggaggcagaggttgcagtgagccaagatcatgccactgtacttcagcctaggcaacagttgagcgagactccgtcaaaaaaaaaaaacaacaacaacaacttagtgctttttttttttttgagacggagtttcgctcttgttgcccaggctggagtgcaatggcgcgatctccgctcactgcaacctccgcctcctgggttcaagcaattctcctgcctcagtctcccgagcagctgggattacaggcatgtgccaccacacccggctaattttgtatttttagtagagacggggtttctccatgttggtcagggtggtctcaaactctcaacctcaggtgatccacccacctcggcctcccaaagtgctgggattacaggcgtgagccaccgtgcccggcaacttagtacttattaagcacagcttctcgagatagaaacatgaaagtcctttcccttatcttgttctcaaaagagcaaactatttcaaagacaaaggtgtatacagatgcttcagagaatattttgaagagattcataaggactctcacttgaattcttgcctttttttttagatagggggtcttgttcagttgcccaagctggagtatagtggcacaattactgttcactgcagcctcggcctcctgggctaaatcaatccttccacctcagtcccaattagctgggactctaggcgtgtaccactacacctggctaatttttgtattttttgtagagatggggttttgtcatgttgctcaggctggtcttgaactcctaggctcaagcgatccaccgccttagcctccaaaagtgctgggattacaggcgtgagccatcacacccagtccttgctgctattaagataattcttgctttggctcaactgaaaaaaaatccaacactgacaactgtaaccatgataagctaattttaagacaaaattttagaaatgtgtttacgatggggcttgatgtaaaaaaaaattaatccaagctcatccattcttcaagttaaaaaaaggcagggtaagaaattatcattttcagtctgctaaaaactaactagacagatatatttagcctaatacatacatccctttctcacctgagattaaaattttattccttgcctcactaagcagctgtttctaactttcaggtattgtaatttgaagcctcaatgctcattagaaattctaagagagtattcctaaatccccattaaactatttgtactcattttggtgagatcagcaccaacacaaattatttatttcatactgcaagtgtaaaaagtattcatgacacaaaatatctgattcctttccaaccaatttatgcaagtgacatttgctaatgtatagaaacatggatgaaggttgtgtgtgtgttttaagatagaagtgaaaggttcaaattttctacctagagataacaagtatcttgaaacttttggaaaacaagcatgtatctctccatgaagccccacagtgatctatatagtttctggagaattgaagaaaaagaagcacagagaagagattatatatgaaagatagtgtgaattttcctaacaatatgaaagatgaataaccagtataagactcctttaaaaacaattccactcttttctaaatttagcgaagcataaactcatcattctagtggcaaaaccgacccttaatgtgaaaatagtgtttccaaattatggcaaacatactctatttggaacactttttaaccaaaaaaggtaaggttataaaacatgccaaacactggtgagaagtctgataggaaataaatctaactgattcaagtagttttttaaaattttcttcagtaagtatatatcctttactaacttctaggcatagattttaaactccaaaattgctatcattaattataacacctaattagttatttaaatttctctcatttaggcaaatgagaaaactaggtagaaaagtcaggaattactttataaggccataaaccaaacaaatccgtttcaagacttcaagcagcaactttgagggaaaaaaaatcttttaaaaattctagaagtccatgaaatcaattaaatagaagacactcaaacatactttaagtaattccccaaatttattactctattttaaaaaattgccatatttcatctttaaaagtattccatagattacttagattacccccagaattcaacatttatataggtggaggaagggagggagggagaaatgaaggacagaagaaaagagaagaaaaaacaagaaaagaaaaaattccaagcctgttaatgaaatcaaggattgattctcatgattagcccttacctacgatcctctgatttggggatggggttggtgcagcgttggctgttatacttggccacatattcacattgcttgaagggggcagtcttgtcctccagaacgtgtctgatacagaaggcgtagccgttgagtcgcctctgcttgcacagtttggggctatatgagcacaagggcttattgtcaacctcagagaagtgtatatgtttcccttcatacatcacgtgactctattccttgtgaacatcagctaaaaggccaccacaaaaaaagaaacccaaatgataaatcagagagtataaggcagatttaagttgagaatttcactgagggacttctggccccacagccatacctgattttaaatcttctgcaccatagcaatgttaagagaacccccaaggataccacagtttggaatgccgcagaatcaggatgaagcagattgtctataaaaatatcaaaaggcctagttaacaaacagaaataagcaaagctagctcacccaggaagcaaaatactaagatatcacccttactaatgcaatggattcttcactgtaaatcaacatcccaataacgaggttaaataagaaaataagagacattataaaacattaagttggctgggcgccgtggctcacgcctgtaatcccagcaccttggaggcgggtggattacttgaggtcaggagtttgagaccagcctggccaaaatggcgaaaccccgtctctattaaaaatacaaaactgagccaggcatggtggcgggcacctgtaatcccagccacttgggaggctgaggcaggagaatcacttgaacccggaagacagaggttgcagtgagccgagatcacacctctggactccagcctgggtgagagtgaagatctgtctcaaaaacaaaacaaaaaaaaagtaagttaccttatccccccaaattgaactaaataacatttgctctggttaagttctataaatacctcaaagcagcaaaactcttccaccaaatgaatgtcacaggtagcaggtctctttttcattactgatgtttgcatgctatactcattttcagaacccacatccctttacaatgccagcagaataaatggtagacctaaaacttctctcagaaattctacttcttttgatatgatggtaaaatatttggcaatttataaatttttctatgaaatacaaaataaattttgtatttaaatttctgtcattaaaaaatgttctttcccttataatatttccccacacctatcccatccaatcacaataaacttctcaggcccaaagactagtcagctgaccacacttatatcattcatttcaaagttctgcaccacatggtgcttccagtcacactaaatagtaaaataatcgtggcttatgagtcttttcagagtcagtgagaaaatggaaggagggaattacacaatactcactaccaatctacacgcaaaaggcccagtggtaggatttatatattacaacaccatctagtctatcatgaaactgaatctattttgccaagtcaggatcttagtgagctgatggagtctcacccatcctcttccacacttccagccatcaagatggctgatggaacagctcagatatcagctactgaaaaagtccagaaatactctctgttttaccagtaaatgacaagatacataaatgctggaggtgtcagaagacacggttgttcaagtccaaaatctgccacttgctgtgttaccttgaacaaatcatttaacctatttgaatgtcagttttctcatctgtaaaacagggataataatagtagctatgttatcaggatactggaatgatcaaatgatacaaagcatccaacatactaagtatcatccctagtatatggtaaatactagagaaacaaattactattcacaagtgttcattcttgtaatacaagactacattccacctgccagtaatgaaagtagagaatttgtagtcttctcaagacatacttcacttactgtagtaggaaaaaaaaaaactcaaaatattaacttagttaataaaaatcatattttctcttctggagggaaaaaaaatcacattcattactaagtaaattaatcacacattaatgtaaaaaataagagctttctcttttcaccttatgagaatgtaagaaaaaaaagttggactagaaatttaaatttaggtgctaagaaactggatatccacatgcagaagaatgaaactagacccccacctttcaccccatacgaaaatcaacttaaaatggatcaaagacctaattgtaagacttgaaactataaaactattagaagaaaacacaggggacactgatgtggggaaagggtttatgagttaagatctgaaaagtacagggtgggcacggtggctcatgcctgtaatcccagcactttgggaggccgaggcaggcggatcatgaggtcaggagctcgagaccagcctgactaacaaggtgaaaccctgtctctactaaaaaatacaaaaatcagctaggcatggtcatgcatgcctgtaatcccagctactggggaggctgaggcaggagaatcacttgaacctgggggcagaggttgcagtgagccgagatcacgccactgcactccagtctgggcaacagagtgagactctgtctcaaaaaaagaaaagaaagagagaaaaaaagatctgaaaagtacagacaataaggtaaaaataaacaaatgggattatattaaactaaaaagcttctgcacagcaaaggaacaaccaacagcacaaaaagacaacctacggaatgggagaaaatatttgcaaactattgaaccaacaagggattaacatccagtatatatataagaaacaaacatctcaaaagaaaaaaatacaaccaattcaatttttaaatgggcaaatgatttgaacagacatttctcaaaagaaggcatacaaatggctaacaaatatttggaaaaaatgctgaacatcactaatcgtcagggaaatacaaatcaaaattggggtaaggtatcctcttaccccacttaggatggctattatcaaacagacaaaaaataacaaatgctggtgaggaagcagcaaaaagggaactcttgtacgctgtttgggaatgtgaaccagtatagccactataaagaacagcatgggccgggcgcagtggctcacgcctgtaatcccagcactttgggaggccagggcaggtggatcacttgaggtcaggagttcaggaccagcctggtcaacatggcaaaatcctgtttctcctaaaaatacaaaaattagctgggcttgttggcatgcgcctgtagtctcagctactcaaggctgaggcaggaggatcgcctgaacccaggaggtcaaggctgcagtgagctgagatcgcaacactgcactccagcctgtgatggagcgagacgatgtctcaaaaaaaaaataaacaaataaaataacagtatgaaggttcctcaaagagctacaaatagaactacccactactaggcatttttccaaagaaaaggaaataatacatcaaagagatatctgcactcccatgtttatcaaagcactattgatgatacccaagatatggaatcaaactaggtgtcccacaacagatgaatggataaagaaaatgtggtatatatacacaatggaatactattcagccattaaaaagaatgaaattcttgggcaccaggcgtggtggctcacacctgtaatcctagcactttgggaggccaaggtaggcagattacctgaggtcaggagttcaagaccaacacggccaacatggcaaaacccttctctacaaaaaatacaaaaattagttcagtgtggtggcacacacctgtaatcccagctactcgggaggctgaggcaggagaatcacttgaagccaggaggcagtggttgcagtgagccgagatcgcactactgcactccagcctgggtgacagagcaagactccatcacaaaaaaaaaaaaaagaaaaagaaattctcttattcacagcaatatggatagaactagaagacattatcttaagtgaaataaataaggtatggaaaattaaacatacatgttttcactcatgtagtcacataaaaaagttgatctcatagaagctaaaagtaggctgggcgcagtggttcatgcctataatcccagcactttgggaggccaaggcaggtggaacatttgagcttaggaattcgagaccagcctggccaacatggtgaaatcctgtctctactaaaaatacaaaagtagccgggcatggtggtgggggcctgtaatcccagctacttgggaggctaaggcaggagaatcgcttcaacccaggaggcggaggttgcagtgagccaagatcgcaccactgcactccagcccgggcaacagagtgcaaccgtctccaaaaaaaaaaaaagaagtaaaaagtagaacagaggctagaggctacaagacaaagactgggaaaggtaggggaaagaagagaatatggagagatttgttaaaggatacaaaattatggctagatgggaggaataagccctagtgttctatagcactgtaggatggctatagttaacaataattattatacagttttgaatagctagaaggaggatattgaatgtttccaatacacaaaaaaatgatgcttgagatgatggctgttctaattaccctgctgattactatacattatatgaatcaaaacatcactatataccccacaaatatgtacaattattttgtgtccattaaaattttttaatttgaaaattataaaacataaacatttaaatttagctgccctggatgtttgggacaggaaatatttcaaagcaaatccatgccatttttcatttttcaccatcttttctctactcacccacaagccaaacacacacgtatctttcacaaattagttcaaagaaacctatacgaacatcaagaaaaaagagcaatctacatgtctgtaggtatgagagcattttacaaatcatagaaagaaatctgagggcagggatggaaggatgtgaagttgcagtgtgccgagatcgtgccactgcactccagcctgggcaacagagggaaaccctgtttcaaaaaaaaaatgcaactcaactgagcattttgtgatgaattcaaccttgtcttacacaaatatttgaactattgcttttttggtttgaatttatcaattgagtctttgcccgtacttctgttcccaacttttgaggcactgtgttgtgttttatttttatttattttttattttgaggacagggtctcactttgttgccaggctggattgcagtggcatgatcatagctcactgcaacctcaaacttctgggctcaaaagatcttcctgcctcagcctcccaagtagctaggactacaagtatgtgccaccatatctggctaattttttaaattttttgtagagactgggtcttgctgtgctgcccaggctggtctcaaactcctgcattcaagagatcctcccgctttggccttccaaagtgctgggattacaggcatgagccactgtgcctggccacactacattttagatctcaggtcagcaaactaaactatttcttacaggacaaatgtggcccactgtctgtttttgtaaataaagttttattggaacacagccatgctcattcatttacatactgtccatgcctacttttgtgctataatggtaaaatttaatagctgcaacagatactatatggccacaaaaataaaactatttactaacatgttatttgttgatcccttttagatgcaactcttgttgggtttgactttttgctccaatctgaatcattttacttttgagcaatttttttttcttttcttttttttgagacagtgtctcactctgtcacctaggttggagtgtagtggcacaatcaccactcactgcaccctcaacctccagggctcaagcaatcctcccacctcagcctcctgagtagctgcgactaaaggcacataccactacacagtgctaattttctgtattttttgtagagacgaggtttcaccatgttgcctaggctggtcttgaacttccggtctcaagtgatctccctgcctgggcctcccaaagtgctgggattacaggcctgagtcaccctgcctggtccaagtcattttcttttaataaatgagtttatccaatttataattttgtatttatgacatatttcatcttaatcctattatattttgtattgcctttagcctttaatttaatcttttcattatacatttcactatattcagtacaaaggtttgaactgtgtagctctacttatacatggattttttttcctcctctgctaccctgacagtaagaccaaccccttctctttttcctccatctattcaatgtgaagacttttatgatgatctgcttccacttaatactaaatatattttccttatggttttcttaataacattttcttttctatagcttactgtattgtaaaaatataatatataatacatatacaaaatatgtgttaatctgttcacgttttcagcaaggcttctagttaacagtaggctagttaactttcttgggtagtcaaaagttctaatatggccaagtgtggtggctcatgcctgtaatcctagcactctgggaggccaaggcgagtggatcacctgaggtcaggagttctaatgcagattctcaaaaaaaagttctaatgcagattctcaacatgtggggttggtacctatactttcaagttgttcaagggtcaactgtagtctgttttcttagaaaaactgtagtctgtctcctttagataacatttctttactccacactaagaaaattagtatacttatcagcattattgcaactgatcccatgttataaacgagaaaaatttccagacttacaactacctacccatccctaactctcaaggctttttcctgttgttgttcttagttctacatttaaatttattcaatgcaaaatgatgcttttttttaacttagtcttccattcacttcttgattcaatagtttacaacacagtctcctctcctttctttccccgaaaagagcagatttgtggaaactataagccacgatttttctatttgaaaacatacgttggccaggtatgatggtgcacgcctgtaatcccagcactttgggaggctgaggcgtgtaggctgctttgagctcagaagttcgaagccagcctgggcaacagagcgaaaccctatctctacaaagaatacaaaaattaggccaggtgcagtggctcacgcctgtaatcccagcactttgggaggccgaggtgaggtgggcggatcacttgaggtcaggagttcgagaccagcctggccaacatgttgaaacaccatttctactaaaaacaaaacaacacaaaaattagctgggtgtggtggcatgtgcctgtagtcctggttacttgagaggctgaggtgaagggattgcttgagcctgagaggtcgaggctacagtgtgccaaaactgcaccacaccgcactccagcctgggcaacagaatgagactctgtctcaaaaaaagaaaagagccaggcgcggtggctcatgcctgtaatcctagcactttgggaggccgaggtgggcggatcatgaggtcaggagatagagaccatcctgactaacacggtgaaaccctgtctctacttaaaatacaaaaaattagccgggcatggtggcatgtgcctatagtcccagctactcaggagactgaggcaggagaatcgcttgaacccaggaggcagaggttgcagttaggcaagatcacgccactgcactccaggcaacagagcaagactccgtctcaaaaaaaaagaaaaaagaaagaaaagaaaacatgtcaattggtgttatacttaaacaacagcttgtctggaaataaaattcttgggttgtgcttttttttatctactgactttgtatatattgtttcatgctgaaaaagcctgaagccagtctcttgattttataggggacttgatttttttttttttttttttgcatgttgacctaacaataaaagtctatttaaagactagaaactgttctaaaattttaaatccttttcttttctttttcactcttgttgcccaggctggagtgcaatggcacgatctcagctcactgcaacctccacctcctgggttcaagcgaattctcctgtctcagcctcctgagtagcggggattacaggtgcatgccaccatgctcaggtaattttagtatttttagtagagatggggtttcatcatattggtcaggctggtctcgaacttgtgacctcaggtgatccgcctgcctcagcctcccaaagtgctgggattacaggcataagcaccacgcccggccttttttttttttttttttttttttttttttttttttttttttttttttttttttttttttttaagagatgaggttgcactataatgcccaagctggattgaactcctgggctcaagcaatcctccaccatagctgggactacaggtgcatgtcaccacacctgccttcaaatcttttattgtgggaaactcttccttaatgtattgacatttctttctgcttgatttattctccgacagcttcaggggtatcaattattggcatactagattgactgtattccctatctgtcactctctctctagtctttcttcatttttatttgttccattttgggttgctcaaatttctcaagcttgcttccattacccccagctatagttgatatttgcactttgaatgtttctgcaatgttacttttctcttattttgtaccctgattccatcagctcactcttacaatacttctgttgtcttcttttatttctcgagcttttatatctcatctttaaactctagtttcagaggaggtatgtctcacccccaccttccaccataggaactattttttcactttcccttgaggcttgactccatgctggactatgttccctaactcacaggagcccacatggcatagatttgggggtggggtgataatttaggctttacttctcttcacatgaccaagatcaggagctgaaaggctgcttgctgccagtttctcctccactctgaacttcctacaaaactggtaggactgcacagtttgcaactcagccccacctctcctgccactcagggagcccaacatacatatatccaactttgccatccatgcatggggattactggttttgtcctcggggtgtgtcactttcttgagagaaagcttcttcctttgctttgcctggttctacagaggaaatcatcctctcttggcatcctctcttgccctggttcaattttcactgcacttaatagcactaatttatatattttgggttttttgggagggttttgtttggtttttttttgagacagagtctcgctctgtcacccaggctggagtgaagtggtacaatctcagctcagtgcaacctctgccccttggatcaagccattttcctgcctcagcctcctgagtagctgggattataggcgcccgccaccacgcccagccaatttttttgtatttttagtagagacggggtttcagcatgttggcgaggctggtctcgaattcctgtcctcaggtgatccatccacttcagcctcccaaagtgctaggattacaggcatgagccaccgcgcctgccgtaattcatatattttgattacaaggttacagtaattgtcaaagttgcagtttagtttctgtttctaattctccctatttttaaagttggtttggagaaggaagaatagagatctcagtacttgctatcattaaccacaaatatctttttaaattttgaataaactattccacaataatatcaaaaccataaagcatacttattatagaatttttttacaacaaatgcattacttttgtaataattttataaaaatctaactttcttctcttttttttttttttaagagacagtcttgctctcttgtcaaggctagagtgtacagtggcacaatcatagcagcctcaagctcctgggctcaattgatccttttaccttagcctcccaagtagctgggactacaggcattaatcactgtgcccaactaattttttaatttattgtagagatggagtctcactacattgcccaggctggtcttgaactcctagcctcaagtgatcctcctgcttcacctcccaaagtgctgggattacaggcgtgagccaccacaaccagcctgaatttcttctaattgagtattattgtagtatcaaaatcactgttctgtaaactggaaacagatcaatatctggtcttctctacattaataaacttctcctttttaaataaagaagaagttatgacaaacgcactgaggcagttctcagaaaaaatcctacatatttttcactctttacccctagccttccacagctggcgttttttaccctgattttactaaaggtgaagttcacatcactttcactctttggcattgagtgcaagatataaataagaatggaaatatacaatatataaagcccacataatcttaatcaaatgtcttttagaccctgatatataaatactatcgcattttctttcttcctttctttcctttccctcttttttctgagacagggtcttgctctgtggccaggctggagtgcagtggtatgattacgacttactgaagccttgacctccccagctcaagtgatccttccacctcaacctcccaaggagctggggccacaagcacatgccaccacgcccagctaatttttcatatttttagtagatatggggtttcaccgtgttgcccaggctggtctcgaacctctaggctcaagccatccaccagcatcagcctcccaaagtgctgggattacaggcctaagccaccatgctcagcctatcacatttcctaatccatgcaaacaaaaggctaaaactaagcactatctttttttgtttttgtttttgtttttagaaaaggggggtgtctcactatgttgcccagctggtctcaaactcctagtctcagtgagcctcctgcctcagcctaccaaactgctgggattacaggcgtgaaccaccatgcccagccaaactctactttttaatacatgatgaatatcactttaaaaagaaaaaaaaaccttagccaaactaaatttattaacagttctagcaaataccatcttcagctgtggagacaacttgcttagcatataaacagacctatgctcccttaaaggagagaatgcaggtaattaaagcactttagagcagcagcagaatatacactgttattaccaaaaaatggaaataaccattactgagaacagaaaatactcaagtctcacttgctgtagaaaaaatatttcaacagcaaacataaccatatactagaattcaagagtaggaaatagccgggcacggagggtcacgcctgtaatcccagcactttgggaggccaagacaggcggatcacctgaggtcaggagttcaagaccaacctggccaacatgttgaaaccccgtctctacaaacacacaaaaattagccgggcatgattgcgggtgcctgtaatcctagctactcaggaggctgaggcaggagaaactgcttgaacccgggaggcggaggttgcagtgagccgagatcacaccgttacactccaacctgtctaaaaacaaaaacaaaaaacagtaggaaatatgattaggtttaggtttttaaaaaatcctcattggggctgggcatggcggctcacgcctgtaattgcagcactctgggaggctgaggtgggaggatcaactgaggttaggagttcaagaccagcctgaccaacatggagaaacccagtctctactaaaaatacaaaattagccaggtgtggtggcacatgcctgtaatcccagctactcaggaggctgaggcaggagaatcgcttaaacccaggaggcagaggttgctgtgagccgagatcgctccattgcactccagcctggacgacaagagcgaaactccatctcgaggcaggagaatcgcttaaacccaggaggcagaggttgctgtgagctgagatcgctccactgcactccagcctggatgacaagagcgaaactccatctcaaaaaaaaaaaaaaaattcctctttgatattatacaccaagtttaataggaaaattgaacaattcatttccattgtttcttacttcttacaaatacagaggaataagacattagcaaggagaaaagtaaggaagatacacttttaacaaaagcagccagcagccctttcagtcttccaatgataaccacaaaacaatttgacaaaaatatgaacattattctctttgggactaccacttgatcacctccatgtggaatctctatgtcactgctgttcttttgattctcctgtttcagaaacatgttcatttcactgccacaccatttttctctaattgccatctgtaattttatatcctaccacttttaaagagcctagatctacaacataccttataatttttttttttttttaaagacagaatctcattctgttgcccaggctggagtgcagtggcacgatgttggctcactgcaacctctgctgcccattttcaagtgattctcctgcctcagcttcccaagtggctggatttacaggcaagcaccaccatgccccgctaatttttgtatttttagtagacacgagggtttcaccatgttggccaggctggtctcaaactcctgacatcaagtgatccgcccacctcggcctcccaaagtgctgggattacaggaatgagccaccgtgcccagttcataccttataatttttttaaaactagcgtgagatgccaggtgcagtggctcatgcctgtaatctcagcactttgggaggctgaggcaggcggatcacttgaggtcaggagttcgagaccagcccggccaatatggtgaaacccagtctctacaaaatacaaatattagctgggcttggtggtgcacacctgtaatcccaggtactctggaggctgagacaggaaaactgcttgtacccgggaggtggaggttgcagtaagccaagatagcaccactgcactccagcctgggcaatagagtgagactccctctcaaaaaaaaaaaaaaaaacctagtgtgaggctgggcacagtggctcataccgtaataccagaaggttgggaggccacggcagaaggattacttgagcccaggagttcaacaccaggctgggcaatgtaatgaaaccctcgacaaaaaataaaataaataaaactaacatgagcctactaaattatcagaatgtttgttttccaatatacttaatgcaaatgaaaagaatatttacttatcccagaaagagtggatactgttaaaatcatatttagagtatcataaagtcttaaaaacgtttttccatgttatgtactttttaaatgagttttaattcaacttgatgaagcataagaatgtaataagacactaaacagatgactatattgattttaagaaccaaacatctatattacctatgtaaaaaatagtaaaatcagactgaggaatgatgaaaatctatcaactgatgtgactggaagagaaagaagcagtgagaaaactgcttatcactcgaaaatataaacaacattcattataatcaagtttgaaccagaatattttaaaataatgcttattgaatgtctagtatgtgccatatactgtactcagacagcactgtacaagtaagtttgcattaggaatttcaatgaactttacactagttccttccctgctatattagaaaggtaaggatagtttatgcagcagaaagatcactcactggctctggtaggtatcagagagggggatcaaatctggttttgctaattactaagtataagaccttgggcaagttatttaggcttcagtcttctcatctgtaaagggaagattgtaattgtatgtatctcattgagttgcctaggataattaaattaggtatttcatgaactgtaaccccagcatatagtaatcacttaatattaactaccattagaagccgggcgcggtggctcacgcctgtaatcccagcactttgggaggccaaggcgggtggatcacgaggtcaggagatcgagaccatcctggctaacatggtgaaaccccatctctactaaaaatacaaaaaaaaaattagctgggcatggtggtgggcgcctgtagtcccagctactcaggaggctgagggaggagaatggtgtgaacccgggagtcgggcgcctgcagtcccagctactcgggaggctgaggcaggaaaatggtgtgaacccgaaaggcggagcttgcagtgagccaagatcgcgccactgcactccagcctgggcgacacagcgagactctgtctcaaaaaaaaaaaaacaaactaccattagaagcagtaagtagtggtttatttgtattatcattttgatctagaatctgtaggactaaaatacattctccagctgttagtggttttctgaatagtttcctataatcattaaaaatctaatatccaaaatatttcctacattctatagagcacttaaatactaatgttcttgtgatggaaaacactagcagaatgagcactgtttgactgatctgggtacagtatttattagttccagttaataatccttcacaacaaatgctttctaagttccgatccatgtcacagtcattctctgttgttacagaaaccctgcattacaggacaagaggaaagaagaaaaactaagttgtagctctactcctcaaagttcttttgtgctaaaaatctgaaactaatggcctctttgttactgaattccacatacacttttccgccttcagctaactggacctctctgcagcatctgacactgctgaccactttctctttcttgaaaatctctcctttctgaccagtcagtgagttcttttctcttgacccccttgcttccatgccaatatactccaaggttcgtttaatcttactttacaggggtgcaagatgaaatgcctacatgggctggaagagtaggccaggggcattctttggcatactttgctcaaatcatttccagcaagttgttgcaatgtttacaaaaaaaaaaaaaaaaaaaaaaaaaaaggttgacccagaacttccagctcttccatgttattaaaagaagatagggccaagcacagtggctcaggcctgtaatcccagcactttgggagaccgaggcaggtgcatcacctgaggtcaggagttcaagaccagcctggccaacatggcgaaaccctgtctctactaaaaatacaaaaattagccggcgtggtggcacgcgcctgtagtcccagctactcaggaggctgaggcagaagaatcgcttgaaccggggtggtggagattgcagtgagctgagatcgtgccactgcactccagcctggcaacacagcgagactccatctcaaaaaaataaataaaagaagataaaaatccaaatttccccacaaaataccttaattgttttcatgtcagcagctcctttaaacttttgaacatatgaaggccgggggtggtgactcacacctgtaattccaacactatggcaggctgaggcagaaggatcacttgagcccctttgtttgagcccagcctggggcaacatagtaagaccctgtctccatttaaacaaaaacaacaaaaaaagaaaaagacagccaggcgcggtggctcacgcctgtaatcccagcactttgggaggccaaggcaggtggatcacgagatcaggagttcaagactagcctggccaagatggtgaaaccccgtctctactaaaaacacaaaaattactgggtgtggtggtgggcgcctgtaatcccagctactcgggaggctggggcagagaattgcttgaacctgggaggcagagattgcagtgagccaatcgcaccactgcactctaggctgggcaacagagtgagactttgtctcaaaaaagaaaagaaaaagacatgtaaccctaagttattttataaatctgtttcctcatgtatgaaaaggtactgaagaaaaatcagaaaccatcacaaaaagtgtgggtcaaacaaaacatttctataggctttatctttttttttttctgagttaagttctccctttgccacccaggctgaagtgcagtggtgtgatcaagattcactgcaaccttgacctcctgagttcaagcgatcctctcacctcagcctcctgagtagctgggactacaaaaatgcactaccacacctggctaatttttgtattttttgtagagacagggtttcaccactttgcccaggctggtctcaaactcctgagctcaagtgatccgcccaccttggcctcccagagtgctgggactacagttgtgagccatggtaccaagcctaccccaggtttcaaaccaaatgtatacaactgcatatgtggatttttctggagaagtgtccaagactaagaaccactgactagcccaaatttgtctacttctaccatttcagcagccgtctgtgaggatgagtcccacatttacatccagtccacctatgagatcgccttacctccttaacatgcctctgccactgctacctcctctcaattgccattgccaccaccttagttcaaaccctcttcaaatctcttgtcaggagctgcctcactggtctaattacagtcttgtcctcctttttcctactctgtataactcaaatcctctaaatctcaagtaatttatgtggccaaagactttcagggtctgcttgtcacgtaaaagaaatccaaactccttcccctaacacagaaactccttaggacctggccagactgacctttccctctcactatttattcccctcctcctccaactcctgggaggtaacagaaccacaatttgcaacacaggatactcttttgtccctaaactttgattcctacttacaggtcacaccttatggaatgccgaactcctcccattcgcttaggacagaaacttcccctgcaaagccctcactttaaaacctagcctgccctttaggccagaatagaagaatattcctccaggctaagctattacttaacattcacattggcattgtaaatgtcagcttatttttcttctccaatagactaaaaactcctcaagggcagagaacgtgtctctattgcaaagctcagagctacaacagagaagctaatctgttaaatgaatgaaccagcagctgctcctaccaatcaagtcaggtaaacatgcccaggactctaaagtgagcctatcaattctacaaactgctcagtgccttcaaaaccatgcaacactaccgtccacggggactcacaaaaacacttcaaaacctgaaagagcggaacgaggagtaaagcaaacccaccctgtgctcctttgccctcggtgtacttactatacctttatattggccaattccaaattcaaacagcagagactatgctaacatgaagctgctgaaatggaatatactgcacaattttttactggcaaaaatatatttatttgccccattaaagtaattataatattctctctgtactcaaatacttattagtattattaatatatactgaggcaagaactcattaaaaattcacatcaagaatattaaaaatctggccgggcgcggtggctcacgcctgttatcccagcactttgggaggccaaggcgggcggatcacgaggtcaggagaccgagaccatcctggctaacacggtgaaaccccgtctctactaaaaatagaaaaaattagccgggtgtgcgggcgcctgtagtcccagctacttgggaggctgaggcaggagaatggcgtgaacccgggaggtgaagcttgcagtgagctgagatcgtgccactgcactccagcctgggcgacagagtgagactcagtctcaaaaaaaaaaaaaaaaaaaaaaaaagaatattaaaaatctttagaaaaaaatagaaaagttatgcaccagaaaaagttatgcaccaagaaaatataaaggttatgcttcaggaaccattctaaaggctttatgttcaattcctcatttagtcttcacagcaaccctatgaagtaggtactattattacccccttttacagacgaagaaaactgagacttaatcagattaagtaattgtcattatccaaggtcacacagtcaggatgcaaggcctatttgctccagagcccaagcttttaaccaatacaaaacgacacaactaccattacatggacaatcctacccttacgtttttcctctttgtttctgctgtatgcatacacataaagagaaaaagcacacgaaagtgttaaacagtggttatcctttgagtgggaaaaacaggtctactctccaaatatagcataagcctactatagtatgtatagtacagtattactttcagttatttaaaaaaggaaacaagagaaatagtatttagatgttactactagaaaagtaaggtggaggccaggcctggtggctcacacctataatcccagcacttggaaagactgaggcaggcggatcccttgcatccaggagtttgagaccagcctgggcaacatggggaaaccctgtctctacaaaaaatacaaaaattagccaggcatggtggcaagcacctgtagtcctggctgactacaggcacacctgaggtgggaggatcactggagcccaggaggttgaggctgcagtgagctgtaatcatgccactgtactccaggctcgacaacagagtgagaccctgtctcaaaaaaaaaaaaaaagaaagaaagaaagaaagaaagaaaagtaaagtgggctagtggaattaacatttaattaatactattatgggccaaacacatggctatctcatctaacccttatatcaaagaattttattcccattttaagttaaagaaaccaaagactaaataacttgcccagcggaaggactgggatcagaactcaaagcccagtctaaaggtgtcactgcaggaagtcatgctacaaataaaatttcaccaaaaactcatcttttattttttttgagatagagttttgctctggttgcccaggctggaatgcaatggtgcaatcctggctcactgcaacctccgcctcccaggttcaagtgattctcctgcctcagcctccagagtagctgggattacaggcatacaccaccacgcctggctaattttgtatttttagtagcgacggggtttctccatgttggtcaggctggtctcgaactccggacctcaggtgatccgcccgcctcagcctcccaaagtgctgggattacaggcgtgagccaccacgcccggcctaaaaactcatcttaaaaacaaatcacattctgtgaaaggatgagaaccaagtagtctgtcaccttacgtgcaaggagggaaaagagggaggcttaaggttttaaattgagtatttcctcagtatctcaaactagccaggagcattgtcaaaaatcagcctttacagtcaggacttctgggacaaactcttgcttgaagaagtgaggagactctattgctgtttgttttgcctagcacagagctgcatgtgtaagttaaactgacttagcactggggacaatttgctgcctccaacccagtctcacctattcaaccattgttttaccagttaccaggtgtgggggagggggaaagaaaagtgtctgagaatattgctctaactgtattcaaatataaatgacttttcattagccataaccattgtaccaaacctggatagtgagagctgctaaccctcagagaacatctcaggtatgaataaatagtttagcatttttttgaaatgtcattaattttgggtgctctcagaaatgtttaattccttctaaactaaaatttttatttctctaaaaatagtagcaacatgatttgctgagaaaaagttggaatgggatatacaaatttcctcctaaaaatcttccagaggaaagaaaacttgattatttcagacttgtaattatactaaccatttactttttaaactaacacttaataataaaaaagcatattcccttagtagtttaaagttaattcagtatttgccctgaaaatcttttattaatttcaaatggaatgtaacttttaaaaacatcaaacctgtcattccttcaggaaataaagtagcccattaggcgatcaggttaggaaattaatacatgtttgaggtagggtgggaaaaagtacaaaacttttttggtatttgtacacatagttttggaaagcttaggaatgtgaagtcaacaatatacctttaaaatatcaaattataaggcaataacaatttttttcaaaccttaaaatgttccaagaaaaatgactaagaatgatttttttccatccagtatatgctctaaaaataaggacaaactataatagaagtaacgatttttggtacacatgtttaaaaaaatgtccatgtcaataaacaatttcaattaatcaataaacttaaaacaaccattaaatgtaatttgcatttttgtatcagatccatacaatctcaaatatcaagattttcttaagctcaatgctaaatgaccggatatctatcattgtggagaaacagagtttgatcttaggcagacgaaaggaaaagaaaggcacacacctagaagaatcacatgagtctcatttcgaagcctcacggaagtcagcactgaaagtcgtgggtgacccattgccctgcaagtggtagcttttcactaacaacagtgctgggggtactgagtgggcagaatgtgggacatctcctgccagcaactccagcctgctaccaagcaggacaccgcacataaacacaacactctgccctaagctcaccaaaaaaaaaaaaaaaaaggaaaaaaccaacaattaaacgatgcaaaataacctctccaaacacgcccacactggggactggcagtggggggtggcagggtctattaacatttcaatgtcaacactcaagaacaacaaggaggtaagcatagccacgggaaacatcctgtccctgaaaagcagaaaatcgagatttggaaatttatgtttatcactttttttttttttaacgttcagagctcagggcaccaaaatatagctaaaattgaatccatttaaacagaaaacatacgtgtgtgtgtatgaatatatatgtgtttatatatgcatataaaatatatacatacacatatatttttttttcgtttaaatgttatacatacacacacacacacacacacacacacacacacaccccaaaaccaaagtagttttgctaggttccgagggctcttccacagacccttctgagttgtagcaataacaagtttaggtttccttaaaatctccattactctatttctaggtcgaatacaagaatgtcacataaaactaaacagtgattatcagaataaatgaactactgatccttaaactgtagaccttgtttcgggagctgccctgcccacttcctctccctcctcccaatcccggaggcttccaagccatctgacaaccacgtctcccccttgggatctgttccggtgttggttttaccggacagtgaccaaaaaggaggggaaactcctacatctggggactgctccagaaaccctgcctgatcctgcccctctcactgacagtctcctcgctgctccctacatcttcctctccgccggagctgtccagaagggggattttggacccaaaggaatcgggatgaaagggggtgggtactcaagctgaaaataacacccccagttggtggggtaagggctaaaaaaggcaatagggaaagattgtccggcagaaacaccacctgagtttacctcctccttcccaccccaaaaacccagtcactaactaataaagctaagaaaagccccttgcaaacttttccaaaccggaagagaaggccctctccccaacctggggggctctagggggaaggggctggagttagcagccccgaatgggctcgcggggagttgggtggggcgcgggcgaggggtgcaggggcggagtaccttcttcaatggacaggaactggcaaagagtttcaaaatagccgagtgcgctcccccacgccctggggggtcccgggcgctaggaccagggctccccggagagacagcggcccccagttcgggcctaaaaggaaactttctgggccgcggctgcacctgactcctcaccgcccctccacccgaccccacgcccgccaggccgcccgccccgccccgccccggcctggccgtccggagcgcggaggagggggataaataaattcaactcttaccggaatctgggggccgtctgcgagagacccgggggaaggggagccgggcgcccattccccactccccactcctaggccctgacgcccctgtcccggcagcccgggcctgccgccccgcgggaaagcctccgggccggcgcgggattcggcccagcagcgccgccgtcccacccggagaccccgggggactcgagggggcgcgcggaggcccggggtgcgggggcagggcgcggctgccgtggggcctaccggcccgaggcctaccggcgcccccccctcccgccgcacacccccacctggcccgcgcaggccgctccgctcgccccactccggctccggctggacccctgcccgcccgccgtcgccgcccgcgggcgccccggaggccctcaggcccccggcctccaccacccgggcgccggccccactcaccctttcattctccgcccggggcctggcgtgggccggcgaatccccggcctcacgtaagcgcgctcgccgcccgcccagcctgcgcggcccagcccgccgccctacgggagcccggggatgtgggccgggcctggggccgcctctgcttacctttcagctgcttttttttttctccttcccccctgttccctcggctgggctgacagatcagagtgagaggcgctggcaatggactaggaagctcggctgccgctgctactgctcccccctgggctccggcgagagcctttccctgtcaagcaagaggggtgaggatcatatttttattttggaaactaaaaagtgctcccagggtcggtgattattaaggggaaatccctgaatatactctccagccaagaaggcagggctgccggggctgtacaagaagag

SEQ ID NO: 1095 - DNA, 83944 bp, Homo sapiens
gccccgcaggggaaggcgggtcctggcggccagcgcgcggtccgcgcccaccctagccgagcggggccggcagagcgcgcggcgtcggtgcccttgaccatggcggcggctgcgcttctgctggggctggcgctgctggcaccgcgggcggccggcgcgggcatgggcgcgtgctatgacggcgcagggcgcccgcagcgctgcctgccggtgttcgagaacgcggcgtttgggcggctcgcccaggcctcgcacacgtgcggcagcccgcccgaggacttctgtccccacgtgggcgccgcgggcgcgggggctcattgccagcgctgcgacgccgccgacccccagcgccaccacaacgcctcctacctcaccgacttccacagccaggacgagagcacctggtggcagagcccgtccatggccttcggcgtgcagtaccccacctcggtcaacatcaccctccgcctaggtaagcgcgggctgggggcaccgccaccgcaccccgtgtccccactccactgggggtctgaggctgaggcctgagctgctgtgcgcccaggttgggctgcaggacccagatatggtgttggatggaggggctcagaaataggaattaggctgggtgcggtggctcactcctgaaatcccagcactttgggaggccgagatgggagggtcgcttgagcccaggagttcaagatcagcctgggcaacgtagtgagatcccatctttacaaaaaataaagaaaaataggccgggcgcggtggctgacgtctgtaatcccagcactttgggaggccgaggcgggcggatcacctgaggtcaggagttcgagaccagcctggccaacatggtgaaaacccgtctctactaaaaatagaaaatttggccgggcgtggtggtaggtgcctgtagttccagctactcaggaggctggggcaggagaatcgcttgaacccgggaggtggaggttgccgtgagccgaggtcgcaccaccgttctccagcctgggcaacagagctaactccgtctcaaaaaaaaaaaaaaaaaaaaaaaaaagctgggcgtggtggtgcacacctatggtcccagctactcaagaggctgaggcaggaggatcacttaagactgagaggttgaggctgcatgaaatatgatagtgccactgtgctacagcctgggctacagagtgagaccttatctcttaataaaaagaaagaatgaaaaaaagaagaaaaaaaaacaggacctgtacccctagatagccagaaggatagactgaggggtgccccgtggggcgggagaggcagggagtcacttgctgagctttggttctaggttgcaattataatcccctgtaatggttttccatcctagaccagaactgttggggaggtgacacaccaaggactgaattggtcaccctctagggcaggggctcctgatcttgggtcttctggtcaacttcaggtattcagtggacccctgaagctgcctgcagtcctcgggtgggttctggaagatagaagctgtgatgttcatcactgcacaggcaaagtttaaccctctggggaggaggactaagtttcttcgtgctgctgggcagctgcgcccggtggcatggcctctctgccctgctcatgacttgccgaggtgcagaagcccttagatctccaggaatcagaatctggagtctggacccagccccggttctcagcccctgcccccactgcagggagctggaatgctctctcctccctccgtgttcagcccgattcccatgtcctctgtggccgggtaagcgccaagtgtctttcctgttgcagcctccactgccctttcaggaggggctggtatcactggttagactcccttatcttcgaggtcagcctcccaaagctttgaaaactcaaattatttttataactcatttttgctgctaaacctgacctgaggctatttataagctatgtttatgctagtgagaatgaatattcattcgctttgctactgaaatctcatttgagtacagccggcagccccagaccccactgggggtattagcacaatatatggtataaggcctgcatcgtctttctaaaagctgaaaaatgttcaattcccaaacacatttggagcctaggagtttggattagggatgatgggactgtatcccatgtttcagctgagaaaattgaggctcagagaggttgttttgcccaaaggcacagagctgctaagtgagcatctgagcgtggacatccatggacatcagaggtcagagcataaactctttgatgtgagttccgccacccatcaactgagtcagctccacctcagcctggtgacagtgtcctggggagggctgggaagtgacattggagtggggtgcggggaggaccgtgagcccgctctgcagagcacacaggtactggctgccacctcagaaactcccttcttctggggccacgtcaccttctctcagcctatctggatcactaggtggggcttctgaatgggacgagggggaggggacaggaagccagtggggaggggggaggctgggggagctgtctggatggagctggcaggaccccaaggccacaggggaaggaatctgggacagggtggggagttgttggggagacacagtgctccatgacaaagggtatcacatgtgtcctgggaacccaggggccaaggaaagagctcagcccaggcacaaacaaggtgggaggaagttgggagaaatggccaagtttttggatttgaggtagttcctgtttactgtgcatctactgtgtgccaggccctgtgctgagctgtgcaccctcgtggaactctgcctagaaccttagaagcagagtggttctgatccttctaaaagcaaggaacctgagagcctccacactgtgaatgtagagagcgaacacacacacacatacacacacacacacacacacacacacacactccctgctgtgtcttatcccggtgagcattcttcctgttttgtcgccgaaaaccaggcatataggagagagtccacaagtgtgagtgacagggtcacctcctctgtcctgtgctctggggccagctcagcattctcttttgcctgctctgggaggcagaataggatagaaatcacgaaaggaggctttggacttaggcccagcagagccactcactgggcaagcggagtcccctctctcagcctcagtttccttacctgtaccgtacggataagagtcgccacttcctgagcagctgttcgggttcatgagcccgggtcggagccatggcagtccctgtgtgtgaccagcgtggctgctgagacagctcagggctgaggctcccttgcggggattgagaaatgctcgtcccggccgccctgcctcctcaaagacatcctgacgctggtctctgtttacgcacaaggggcgccgggggcccagcgcagccccagatttggcctctttttggtttcctatgacttaggtttgctccaggctaagccatggcttgcataatagcgggggaaggagaggcctgggattgtcggtgtcccctgtggaggccgtctgatgacctctcctcctggtccttaggccacctctgctggctctgtccccccactgctccctctccttgaaggctcatgggaagggagagtgggcggccagctctggcccggggtctcctagagggaatggggtgaggggcagggaaggagatggaggtcgccgcattcccagccccccgtggctcctggacatctgttccggatcctcccgtcatctctgagctgagccttcctgtctgggatgaaaggcagcagtgggctctggcagccccagcccaccaccaaggcccagggaggccacggggctggggcctgggagtcagtggggtgttgggggagtggacagtgacgggggtacagaccattccggggctctcaccgtgtaccaaggactcgcccaggcggcatcccaaaccggcatgctttgttcttttacagacagcaaaactgaggcactgagggtgagatcagttgcttggggtcgcacaactcaataaatggtggcccccgggaccctccccctaactgctgtacttgggaatgaagagggtccaggctaggctggtccacatgcttgaagcctcggtcctgggaggaacagtatgggctgtggctttcggtgggctgggggagtctcctcccggcttgcacttggatcgctgagaatctcctggaaccacaaaaagacctgagtcccccaagcagatgagttctgccctccctcccccgcaggtcccggatgtccctgcatggagttgacttcttcttgctttcatttagccgtttgcttggtggtcacccagccttggctcactggccacaggatgcagctgtgaacagggccatgtgcggcccctgtcctgaggggctcagggcccaccagaaggcagcctttactgagcagtgctgagaacgaggatgtatgctcagaacatgcactggtgcgcacgagcctcatctctagggtcaggaagggtctcgctgagacctgaaggatggtaggagctgaccaaagagggaaggatgttcttcgacctgccgggcctggatggcctgagtgcagacaccgagaagacgctggggtctggccagccacagcgaggagccgggtcccagggtgctggacattagggggaccctgtggcccctgaggggtcctggagccagctgggtctcctgagccttggctccgttctgtcttcctgtcgagtgggcggctgcgattgccttggcctgggccagtgctgggggccaagtcctccctcctgctccctgggggttctggctggaacgctgggccctgagcagggcaggaggtcaaggcagcggctggttagcctccatccacccacagaactgccctccaggcccctgggcccagctggccttggccacctctttctctctgggcctcccaggactaatccaggagatgcagggctaggaagtggcaaagcccaggatgggtgtagccagcctcccatggcctctgcatcatccctgtccacttcccacactgcccttcagcaaggccttggctgggccgaggcactctctctcctccagcgccttacatgtgctgtggcttcggcccagcgcacttctcctcccaccttcagcctaactcatgtcttgttcatccacaaaaccattgcatgtctgccgatccctgtgctgagccctggggatgtctgtctgccccactcagcttagaggtgcctcctctggaaaacccctcacccctctaaggttgggcagaaggcctgcccacgcatccttgcagcccctaatcctccttccaccagagtctggattacactgcgtgagggcttggtctgtttacgtccatccctatctctgggctgccagagggaatgcctgttttcacacctgtgccccagtagtgcccagcctgcatttgcccactgcacagggtgctgggtaaaggttggtcaggcgaatgaatggaagagcagctcaaatttcattgaggctgggtgaggctcacacctgtaaccccagcactttgggaggcagagacgggaagatcacttgaaccagaagttcagggtcagcctggacaacaaagtgagaccctgtctttacaaaaataaaaatagaaatgaaaaaattagccgggcgcgggggcaagtgcctgtagtcccagctacttggaaggctgaggtgggaggatcgctggagcctgggagttcgaggctgtagtgatcacaccactgcactccagcctgggcaacagagcgagaccctgtctcagaaaaaagaaaaatgtagttgaacaaatgcttcgtgcctgggactgttccaagtgcttccaaggcatttgctcatttagccctgttattgttatgcctattttgcaaatggggaaaccaaggcactacattgcacagtcacttgcccagtgaacccgagggagttcagctattttgcccaaggccacagagccaggaattggtggggctgggctgtgaaccccagggttgcaagattgcactgtgtttcctcgctcagagcaagggagtgaggaattcatggatgaagggcccccagccttgcaggtgcctcccgtactcctaagccacggtgttcacagcagtgccgccgtcctcccagcccaaccctgccctgccctgctctcccttgcccaggcttcagctgcttggtctacctcccttccctgtggccccttgtccccgggcaagccctcccagcagccatgcccttccccagctcatgccctggctttgcttatttgaatcatagtcgacatccaggactccacctgcacccctcgccctgactcggtctccacctgagccctcgactgggtaatttgagcagccgccttgacaccaaccactctgaatgtcatgcaagggcccccgtgtgcaaaggctatgcaagggcccctgtgtgcatagcagcattttcttttcttttttatttttttgagacggagactcgctccaccgcccaggctggagtgcaatggtgcgatctcagctcactgcaacctccacctcccaggttcaagcgattctcctgcttcagcctcccaagtagctgagattacaggttcctgccaccacacccagctaattttttgtatttttttgtagttacggggtttcaccatgttggccagactggtctcgaactcctgacctcaggtgatctgccctcctctgtctcccaaagtgctgggaatacaggcgtgagccacggcacctgacccataacagcatttccacaatagccaaaggcaaggcagcctaagtgtccaccgaggggtgaatgatgagcaagagcaaatgtggtccatccatccagtagaatattactcagccctgaaaaaggagattctcacacagccacagtatagacgaaccctgaggacattatgctaagggaaagaagccagccaaaaaagaacaaatactgtagggttccgctgatatgagaggcaccctgggatagtcaagtccacagagacagaaggtagaatgctggttgccaggggctgggggaggggcaatggagagtgactgtttcatggggacagagtttcagtttgggaagatgaaagagttctggagatggatggtggtgaaggttgcacaacaatgtgagctgtgcaaatgggtaagatggtaaatgtcatgttatacatatttcaccacaataaaagaaggtttggggaaaagtacatgtcagccccgtgggaaggcagcttggcaacatggttgaagacccacaagaatattcctggcctttggcaaaggaatcctacttctgggaattcaaataagggaagggtcctaatgcatgaaaacattcatcgaggcgttctttatagtagggaaaaatgggaaccataagggactagttaagtaaattgtaggacataaattctcatggtgattggagccattcagtgcaacagctgacaaagggtttgtaatacacagggagcgcttaagtcaaaatgttgaatgaagaaaaagacacaagttggtatatgtggaatcatcagatttatattttaaaatccctaaagagtaggcaaaaaaagaaagacatcaaactggtaagcgtgtttgtcctcaggacttgcagtgacttttcttccattttccgtgtttctacattttcccagtattctctcatgaagcttgttctaatttaaaaactggagaaaacacatttctacgattttttttttaaaaagcacccgccttgctatgttctgttttaagatgtttttcaaagttctggtgcagcacagcttggcaccgtaactcccaaccccttaaaagaaagcgtgcggagcaaacagggtccggatctgggggcggcctggtgtctgcgcctgtttggagcagaggcttcgggccttggaacgaggtggggggctggcccagatgtgtattcgctaaaggatgctgtgcgcgggctgctgcgggtcaccggcgcagactccttggtaaacatctagcagccagacacctctcgggaggggagcttggagccacttgaaaggtagctggcagctagaagcgtgatcggaaaaaggcagtcactgggagttcatgcaaacgagcggcctcacgcgataggaaacatcccggcttttctgtccttgccaaaccaggaggtgagagaagatgcagcaatatcacagagacatggcagggactttttgttacaagagttaattagaggccgggtgcggtccttacgcctgtaatcccagcactttgggaggccgaggccggcggatcacttgaggtcatgagttcgagaccagcctagccaacatggtgaaaccctttctctattaaaaaaaaaaaaaattaaccaagcgttgtgttgggcgcctgtaatcccagctacttgggaggctgaggcaggagaatcgcttgaaccggaggcagaggttgcagtgagccgagatcgggccattgcactgcagcctggatgacagcaagactgtctcaaaaaaaaaaaaaaaaaaaaaaaaggccaggtgcagtagttcacacctgtaatcccagcactttgggaggctgaggcgggcggatcaccttcggtcaagagttcgagaccagcctggccaacatggcaaaaccccgtctctactaaaaatacaaaaattagccaggtgtggtggcgtgtgcctgtaatcccagctacccaggagtctgaggcaggagaaccactggaacccgggaggcagaggctgcagtgaaccgagatcgcaccactgcactccagcctgggcgacagagcaagactccatctcaaaaaataaataaatacataaataaaagaaagcagcttaatccctcctttgtgatgaaaaagtttcttccaaaggcaacaaaaaggttgggaaaggagtggccccaagatctttttttttttttttcttgagttggagtctcactctagcccaagctggagtgaagtggcatgatctcggctcactgcaacctctgcctcctacgttcgagcgattctcatgcctcagcctcccgtgtagctgggattacaggtgcatgccaccatgcccggctaattttttgtattttagtagaaacgaggtttcaccatgttgcccagggtggtctcgaactcctgagctcaggtgatccccctgcctcggcctcccaaagtgctgggattacaggtgtgagccactgcgcccggcccccaagatcttttaaacagcgacgagaattaaaatctgcagccctagcccagaccctcacaagctccaggggccaatgaggcttctgggtgattgagacagctgtgttcctatcaggaaagccgagccaagatgtcatccttgactgttagctggtggtgacactgcttgggagtacttggcttccctcacctccaggccgcccaatatgctgttctctctgtctagaattctgttccctctgctctcctcgcctgtctagctcccatgcacccctgctcatcccacccgcttactggaccacatgccccaaacttacttctcaccacctcctccctctccatgctcctgccagcctgaactacaggcttcaccacaaggtggccacagctttgccaacatcctgcctggtgtggaatgcaccttctcctcaccttccctggctaatggctgctcatccttggaaccataggtttgagcgccttgttgatgctcccacagcctccctgggctactttgtcctgttctataaagacctgcctgtctcatctgggcacggtggctcacgcctctaatcccagcactttgggaggccgaggcaggcaaatcacttgaggtcaggagtttgagactagcctggcctacatggtgaaatcccatctctacagaaatacaaaaattagccaggcttggtggtgcacgcttgtaatccctgctactcaggaggctgaggcaggagaatggcttgaatccaggggacggaggttgaagtgagccaagatcacgccactgcactccagcctaggcaacagagtgagactttgtctcaaaacaaacaaacaaacaaacaaaaacaagacctgcctctctctccctacctgtaacctccccttggggcaggtgccatgaatccttatagctgagcatggcacctagcacacaagaggtgcccaataaatgcttgcccgatgaatgagtagactcgaggcaggatttgtaccttcaaggagtttataatccagtgagagagtggagacagcaggcagtcctgacagtgtggatcacattgtcccaagtgtgcctggaagtcatgatccctggatgagtctctgtttcacactagccagcatttagtgagcacctgctatgtgccacgtgctttgccaagtactttactcacactgtatggctgagatccccaaacacttcatttactagtgaggagtcaggctcagggagcagaaggacttcctcagtgtcatgcccaaagtcactgctcaaaacctgggtgccctcctactcaggagtccatggagccccagagagaaggggctgcctaggaagggggtgaagggggtgctggtgcccatggagacatggaggtcccacccgcccccctcccagtcttcacctgctggctgagccagcagctgggcacagcagagcctcccccggccgggccccgcaccgcccacgccaaacagcaggagcgccaagctgtgtcctctccagccagctggaacataaagcccatcaagaatgacaccgggacagtcataaaatcaagctggcccacatccggcactgaccaagcagaatgagctcagtacgaagaggcttattttgggaaaatggaaacaaaacaaagccctataattggagccatctgggcagcagtggcctagggagtggggcgggaggggctagggtggaaagctgggctgggaatgcatgggtgaggctgccctgcccacctcgagcatcagaaccaggtgggtgagctgctcccagcctacaggggagtcacacccagcagggtcccttagccccatctggccacccactgttcttgttcttcctctcccagccaagctcttggcacttctgggtgtggtgactccctataaggagctggggactccccatggccataatgccagataccacaagaccctggctgaaccagggataggctccatcacagccctcccatcttggcactaagtctaagccccaaatatgaatcaagattgccaagtctaaaaaaacaaaaagattgccaagttctcctctaacctggggagaccaaacagttttccttggattgagtgttgcctagggctttgtgttaagaaggattctgaggtacagtctgagccaaaacatgactgagacatgactgcatgtttgcaaagagaggtggcagggcattccagaccattgcataagtcagggaacagacgaggggctgagagaatgacagagaggagggctaacacaaggaattccagagaatgagctagtgatctggtgaatactgaggtcacttgcgagaaggaggtgattcaccagcttcttgttttggtgcatagagagactaggggaggaaggagggtgcctttatttttcccccccaaatacatgtaacacaaacgtggagtctggctttcggttcttttgggtatatccccagaagtggaagtgctggatcatatggcaattctattcttaggttttttgatgtttttttttctccccagagtctctggcttcttttaattagttttaacctttaagcttttgtaagcgtaatcaaccagctgaggatggtaggggatatttcccaacacttctcgtgtaaactcaaattgtaggttcttgcttggagtaacacaggctcttcactgcttacaaggttattcttgagttgcaaaaattctctctccgtagtttttcctggattcctctattcaatctcggctgccacagaaagcagaaagcagtcagagagaaagcacagggacgctgtttttgcatctgtagtggaaaccttagcagacagtaactgctctggggctgtcaaatagatgcattgtttttagttttttcgggaaccaccagtttcccatagcgtatgcaccatttcacattcccacccacagtgcatgagggttccagtttctccatatccttgccaacacttgttatcttctgtttttttgataatagccatcctaatggatgtgaggtccaataatacatatatataactgtgtagggaaaaactcctcaaactgtgtttttcctctgctctcagacgacagccatcatcaacacagaagacttctgtgaccaaatgcgtgggtttttcccccacccaacaagcagcggtaccagctgggtgtcctctaattcagttccaacacgatctagtcagagatagcatccggtcccacaggttgagggctcagtccccaaggctgtcttccgccacacacaccagtcacaagtctaggcctcacgaacttctgacagattagcttcaagttcccatgaccccttctttgggttcaatcaattcactggagcagctcacagaactcagggtaacacattgactggtttattataaagaatattgcaaaggacacagatgaagagatgagcagggtgaggaacggtgaagggacgggagcttccatgccctccctgggtgccaccctccaggaacctccccgtgttcagccatccagaagctccctgaaccctgtcctcaggttttcatggacgcttcatgcatcagcattgcttcccttgggcgtagggtgggaccctctcttggagggtcttaagacccacggtcagaaaggtgggggaactttagagtgaaaggagggcaggagaaggcagaggcctgcccctgaggcccaacacacccaaaattctaatgaaagaccgtaaggagggctatgggagtcataagccaggagctgtggatgaaaacacacacacacacacacacacacacacatatatatgtatttttttaatagagagacatggtctcactatgttgcccaggctggtctcaaacccctaggctcaagtgatcctcccaccttggcctcccaaagtgctaggattacaggtgtgagccaccacggccagcccgaaaactgacagctatcataacaccacaataacatacatagtatatataacagctttaggagatacaattcacataccgtataatttacccatttaaactatacaatccagtggtttttagtatatacacacagttgtgcagccatcaccacaatcaattttagaatatatttatttatttatttatttattttgagacagggtctcactctgttgcacaggctggagtgcagtggcacgatcacagctcactgtggcctctacctcctgagctcaagccatcctcccacctcagcctctcaggtagctgggatatgcaagccaccacgcccagctaattttttaatttgttcttatttatttatttattttttgtagagagaggatcttgctatgttacccaggctggtctcaaactcctgggctcaagcgatcctccagcctcagcctcccaaagtgctgggatgacaggtgtgagccactaagcccggcttggaacacctttattaccctgtacctattagcagtcactttctgttttcccccagtccccatcctgaacccctatcctgtgacaaccacctgtctccttcctgtctctgtggatttgcctattctggacatttacgtggaatcccataagatgtggtctttggtgattttagcttctgccacttaacgttctcgtggttcattcttgtggttgcgtgtgtcagcacttcatttcttcttgtagcccaatcatattccatcatatgatatatgccacgttttattgattcattcatcagttgctgggcattggagttgttcccactctttggctgttgcaaagaaagctgctgtgaacatccatatgtacgttttgcgtggatgtatatgttttcatttctcttgggtatatgctgaggagtggaattgctaggtcctgtgataaccctgtgtctaacattttgaggaactgctaggcgctgttttccaaagtggccgccccattttacattcccatcagcagtctatgagggttccaatcccccaacttcctcaccaacatttgttattacctctgttcatgctacccagccttgagggtgtgaaggaaatctcattctggttttatcttgcatttccctgctggccaatgatgtggagcattttttcttgtgtttcttggccattcatatatccactttgcagaaatgtctattcaaaacctttgccatttttgttttttcttttttgagatagagtctcactcggttgcccaggttggagtgcagtggcgtgatcatggctcactgtagcctctaattcctaggctcaagggatcctcccacctcagcctcccaagcagcttggaggcacgggccaccatgctcagctcattttttatattttttgtagagatgaggtttcgtcatgttgccctggctagttgtgaactcctgcgctcaagcaatctactcctcctttgtcagtttttaattgggttgtctttttgagttgtaagaattctttatatattctggataagtctcttatcagatatatgatttgcaactattttctcccactctgtgggttgccttttcattttctcagtggtgttccttgaaggacagaagttttggttttgattaagtccagtttatgtattttttcttttgttacctgtgcttttcgtgtcatttctaagaaggctcttctagtgcaaagtcccaaatattatttactcctctgttttcttctaagaaagaagttttagcttttttttttttttttagacagtcttgctctgtcacccaggctggagtgcaatggcaccatctcagctcactgcaaactccacctcttgggttcaagcaattctcctgcctcagcctcccgagtagctgggattacaggcgcccaccaccacacctggctaatttttttatttttagtagagacagggattcaccatgttggtcaggctggtctcgaactcctgacctcaggtgatccacccgcttcggcctcccaaagtgctaggattacaggcatgagccaccgcacccagccttttagctcttacctagagccaagatgtttcagcagacgactagggtggcttgtcctcggcacctaaggaagatggtggtggcagtgggcagtctcttgggggtctctgggaccagggaaggaaggatcagagaatagaaagccggccatggggaggggactgggcatcttctgtgctgctctgggaagtgagaggctactgccaacggtagagatgcaggagggactccctgcgtgggccgttcttcccttcattcattcgttcctgcaccaacactcagtgaatgcctgccaggtgtcaggcaccttgctaggcactgggatggcagagattaccaaagagacgcccggtgccgacggtgaggagctctgtccagtgtggggagccaccgctgagcaggtaactctgcaggaggctagctaaggagtcacattgcaggaggccccctctcctgtcctggggggatgtcaggggtgtgcattagggcttaaggttgagttgggcttctgtgaggagggggtacctggatggagtcctaaacataggaggatggggagagatggtggcatttcaggcagtggggaaattgcctttttaaattcaggctgtacttccttcttattattgaaatcatacccgctctcagtgtagaagccagatacttcccagctcgaactgtggaaggcggcagttctcccgcgcccgcaccccaggctccctctccgcccggcgctctctgagccatttctgttccctgatgcatccttatctcctagccctgtgcctgcactgccatgtcagggtttttctcttcttaggcattgcctgttgacatcccatgagggaagaggaggaattgggaacccccttccctctaccacagccatcctccctaccccagcctcccagggtagctgagtcattgtgacggagccaggtctgctgttgaggatgcttccagggtggagcgcagggcaggcaggtgcctaaagcctgcagatcctccagctgggtgtcgggggcatgtgggggagtggggctaaagcccagggaagggagaggccactggaagctgggggttcagggagcaagcagaggggctcaggagggggccaaggcaggcaaaggagaggagagcaggtggaggccccgggagaggggactttcgaggaggtgagcatgatcagaggcccctggctgtggccaccaggggctgtgggtgaggtaactttgcaagtacagtgtcttctgtggagtggcccagagaagctgaattgcaggaggttgaaggttgagttgggagatgaggctgtggggcagtggatttaaacctgtcttgggaaatttggaagatagaaacttggagcaataaggggtccagggaggatttcgttaggattaggagatatgtggtcattgcaagggaatgaggccgaaggcacagtgcaaggatcagcttcgttggggtgtagtaaaagaaataactttctaacggtagagcaggctttcttagaatgtggcaacatcccattgctggagatatttgagcaaacagagatggctgcctctcaggggtgttgcaacggagattcctgtgcagggtggcgagttgacccagaagagggacagcaaatacttgggaagcatgtgggcattgtcctttccagtgccccagcaggcatcatgaatggagggtggcttcccctgtccagagctccagacagcttccagcgatccatccacgctagtgcctgcaatgcagccgtctgtccttcctagaccaggattccatacctccttccccttccataaaatgggccccgttttcctggctgcagggaaggcttatgagatcacgtatgtgaggctgaagttccacaccagtcgccctgagagctttgccatctacaagcgcagccgcgccgacggcccatgggagccctaccagttctacagcgcctcctgccagaagacctacggccggcccgagggccagtacctgcgccccggcgaggacgagcgcgtggccttctgcacctctgagttcagcgacatctccccgctgagtggcggcaacgtggccttctccaccctggagggccggcccagcgcctacaacttcgaggagagccctgggctgcaggtcagggaggagcggggcttcggaggttgggacggggttgggactgggtcacggcagtaggagggtctgatgtgccaggacacacagggtgggggacctgcaaaaccccatggttttctttttcttcttttatttttggagactgagtcttgctctgtcgcccaggctggagtgcagtgacgcgatttcggttcactgaaacctccgcctccttggttcaagctattctgcctcagcctgccaagtaactgagattacaggtgcccgccacgactcctggctgattcttttttgtatttttagtagagacgggggtttcgccatgttggccaggctggtcttgaactcctgacattaagcgatccacctgcctcggcctcccaaagtgctgggattacaggcatgagccactgcccttggccccaaaccccatggttttcaagctttctgccacagaaggcttgttgcacccaagtcttctgtggatgccgctaatgaaccagaaggaagacgggctactcagtggaccagagctgtcccttccctggcctcctggggcagagccctgtggctcccaggagcctgtgagggctgtcaacccacctggccccttccttatatgggtgtggaagctgaggcctggagggagacagcattttccaggggcacaaatgaggcgtggaagggcccaggccagcacctgagtgtccagactcctggctggtgttctttccagaactctccgctgaggggcctcgcttcctcctcctgtgaattagtaacagggcctgcccatgtgtctccaagggctcctatgaaaatggcaaaatgtgacaggaacatgggctttggagtcatagagccctgggtcccacgctgtaagtccgtgccaaccagcagcactttctgtgatgacggaaagcgcctctagctgcattgtcccatgtggtgccaccagccaccatgagatgtggccagcgcagttgaggaactggatttcatattttattattaatattttattattaaatattaataaatttaataaaataataattattttattaacttagccacatgtggccagtggctgccacgttggagagactgctgtggggtagcgggaacacacacactgtgaccagtgcggtgcttggcacgtagagcgtgcccacccacactcgggagatacgcgcgcatgacagctccccgtccttgtcctcacggtagagaggacggctggcctgtcgccatgtcagtccattcagggccctccagttcagcccacgtaggtccacccaggtgtgcggacctgccgggatcggcacctatctgtgtccacgttgctgtgtgtccatagctgttcatctccacacaagtgtgttgggtggctctccagtccacaggtccccaacccccggctgcagaccggtactggtccatggcctgttaggaaccaagtcacacagcaggagatgagcgcgggcaggtgagctttcctgcctgagctccgcctcctgtcagatcagcctcctgtcagatcagcctcctgtcagatcagctgcggcatcagattctcccaggagcaactgggttgcgtgtcctcctgagaatctagtgcctgatggtctgaggtggaacagtttcatcccaaaccaccgcctaccccgttcgtggaaaaatcgtcttccacgaaacctcttcctggtgccgaaaaggttggagtaccgctgctctagtccatttccccgggttcagacccaagacgtgtccaaacccagggaacctgccctctcctcccctccagactttcagagcgtctcctttgcccatctgggataatgagggaaccagggttagaatcctgtttccagaggggacactgacacccaaaaagaagttgcgttctgtcagcgatgtgcagcatgagaacacacggagccggccgtgtcggggtccccaggaccacccttgggtttagtggttcgctataaggactcacggaactcagaaaagctgtgaggctcagagctgcaattttttgcaatgaaaggctaccggctcacatcagccagtggagaggcgcccggccaggtcacagaagggaccaaccaggctctgagcttccagctgttctcccaatgcagtggagtcacacgcacagcacatatttccccagagccacatgtgacagtgtgcgtagagtactgccaactttgaaggccagagttttttaataatttttttttcttaaatagagacctcgtctcactatgctgcccaagctggtctcttactcctgggctcaagcgatcctcccacctcagcctcccaaagtgctgggcttaaatgtgtgagccaccacacctggcctgaagtccagggtttttactggaggctggcagtgtagacacggctgaccacctgtgtggctgacctgtctccagcccctccagaggtgaagccgattctgtgtggcccgaggcccccaccgcaaatcacatcatccgcatagactacctagtgtggcccaagggaagaccctcttatcaggagggacatccaaggatatggaggtcactcccctggatccagggcaaagggccaggcccctctttgggcaagccgaatcctttatcacacagtaccacatctctagacgtccaggccctgcttgtcccactaaaattgtacatgtcaccatgattttatttaaaaattacaatttcttctccacggggctccaaagctctgtagattagaaaacgtcacccgaggtcagatgaagacaggcagggagggccggcccccgctcccacctgcgtctgtgcagccaccaccgtggggacacccttggctgttggaggttttctgtcttgttgcctcttgtgttctggacactgtccctgatggagagatgaccttttgagaaatatctcccctgctgcttctggacagaaaccaagagcagagcaggacaaagagaggcaagtctaccttgctcttttctcctcatgctccctctggacacatttagggggcaggtgctttctcagaggacacagagcttggaaggaaggatgtggctgctgggtcttgggtccctctgacccccaaggaagggcctaggactttggaggagaaggtcgacctggctgttgcagagtaagaccgccagagttgaggggccgcctgagcaccccttggacatagagcccaagctgtccacctcctgcttctccttaatgccatggcctgagtcctgggatccatctaaaatcaactccagcacccactcatagcttaagctggagttccagtgcctgggttcagtggggattgccctaaaatgactttttttttttttttttgagacagtttcgctctgtcgcccaggctggagtgcagtggcacgatcttggctcaccgcaacctctgcctcccaggttcaagcaattctcttgcctcagcctcccaagtagctgggattgcaggtgtgtgccaccacactggctaatttttgtatttttagtagagatggggttttgccatgttgtccaggctggtcttgaactcctggtctcaagggatctgcccgccttggcctcccaaagtgctggcattacaagtgtgagccatcacaccaggccctaaaatgacttttaaggcatcaagacagtccccctgcaattgaggctaaggctgctctctcccagcatccatcctatgtctcagagattttgaccccattcctttgtggtcattgtccttgcagactgatggatcaggtcacaggccaggaagcagaggtgggagaccttgggcaggtcattgctgtctctgggccccactggcatgataagggctttgggatagacacaggaaggcagaccagcctcgtggttaaagctgggaccctgggatcagatagaccagaatcccagctctgccatgcactggctgtgcaacttggaacagaagggttaccctctctgagcttcagtctcctcatctttaaatggggttaataacaatacctacttcagggttaccgtgaggcccgagccctaaccatacaatatgtgtcagtagccgccgcacctcctggctctggtatccagttggtttgagttctccaggtggcacttttttctggagaaggaatcgccacagcgcgttcagctctggactgcgggacttccccaccccaggcctcagctccttgtccagtagccggcccagcagcatcagtacctgggcacttgtgagaaacgcaagctccccagctccaccgctgacccctgaatcagaagctgcactttaaccagatccctgaatgcacgctgagctttgggaagtgcatcctggggtgatccaggcctgcaaactcaagcacaagcttagcttggtgcagaggctcccactttagtgtttgggtgctggacccctctccctggccaaggcatcctctggcagaggccctgggtccccggcagtagctccggttgccgagctctcggggagcaggagggccgtcggcctgagtcacgctggggcaaaaagatggcctgccaggagctcattttctgcactgatgggcctgattgctaaagcaggggctcctgggcggaatcaaaacgctgattaatattcagctggagctgctgctgctgctcacagcaggcaggtgaaaatgtcagtcttcacgtgggttttccccgacttcccctccacgctcttccatggggaagctgctcattcagggatcagcaggtatttatcgagtgcctgctagggccaggcagagcccagggccagggaaacagtgagaacaaggggccacaagtccctgctctcgtggaagagatgtcacctgaggcaggtgacctgtccacaggagcctgaccctcagcatgtgaggagccaagaaacccggggccagctgcatgccaggccccactgagcaggggagaaggttgcgggggcacaccgtcccccagctgtatccctggaatgaggtgcaggagctgctgggaaaagccaggtgacctgcacaaccgggtcttcagtgggctgctttgacccctgcccgcccaaacctcagctgcttcctgaccacgggcccgacctcacagccagcactgatacttgctaccctcccccagacatgtttgtaggggaggtgctatttttgttccaattcacagatgggaaaatggaggctctaagacactgaatgcagttgcactaatcagtagcctagcacccaggttggggtgacccccaaagcacagcctccttatttctgcagtgttctcagaattggcctgagctcggcctgttcctgtgtcccaggagctcccggggcagccagctggatctgccagcagagcgatgggggtaaatactaaatactcaggaacctgctgatggcaccctctcccctctgccccaggagtgggtcaccagcaccgaactcctcatctctctagaccggctcaacacgtttggggacgacatcttcaaggaccccaaggtgctccagtcctactattatgccgtgtccgacttctctgtgggcggcaggtaggagggaggagggaggcagggtggcagggctccaggacccaaacccgagagcggaaggtggctgctgtggggtggggggtgggggggcacagaagccaggtgtgccccaggggagagggagggagcacctgccattcgaggccctgggggtccacacccagcccacctcctgccgggtcccctgcatcagctgatttgccatgtgccagacactgggtcttggttcccattgtcccctcagcctggaggttccttccttcctccctccctccctcccttcctcccttcgctctcgctctctttctctcgctctcgctctctctcactcgctctctctctcttgctctctctcgctgtctctctctcttgctctctctcgctctctctcttgctctctctcgcttgctctctttctcactcgctttctctctctctctctctctctcactctctcttgctctctcgctctcactcactctctctcactctctctcgctctctctctctctgaaggagtttcgctcttgttgcccaggctggagtgcagtggtgcaatctcagctcactgcaacctctgcctcccaggttcaaggtattcacctgtctcagcctcccaagtagctgggattacaggcatgcgccaccacgcccggctaattttgtatttttagtagagatggggtttctccatgttggtcaggctggtcttgaactcccagcctcaggtgatctgcccgccttggcctcccaaagtgctgggattacaggcatgagccacggcccccttcccctttctagtataggggtgttactggcctagagaaaggcgcttctctctggcccgtggtcctggtcctggtcctggtcctggtcctatgcgccattagcacccatcagtgctgtgggcagtttgtttctcctccaacatctgtcccctccaggaagcaggggctgcctaggaggtagaggcccatctctcacctcaagtcccaaggcctgtctcgcacatggccacctggcagtgggtgcccagggagggctgtgggacgagggaggcatgaacagcttccacgtcagtgtttctcaggtttctttgaaaggagagaggaaaacaggtgcgttcctgccccagtcacctggggatggcagacattgatcagattgctccccagtgaacacatcagcccgctccaggatgacaaggaaggagaggaaagggagagcgtgtgcctggggtcggggaggacaggagctggtgctgcagatgggacccaagagtgggaaggctggggttgaggactaggggacggccaacgtggctgggtggagggcaggcgggtgggcgtggagaggttggcagagtgtcagggcctgggcgggtttagcctcacccagaagtcaagaggaagctgtggaaggatttggtcagggtagtaacagagtcagatttttaaaacacccccaaacccctgacagccaagtggggcagataggaggagagaggaagtcgaatgtcaggaatcgaggcgggaggcggcagcttggaccagagggctggggtgtggggcgcgtgggtctgaacgcgactgaggatggaaacgcagctctgtgtgtgaaccatgggccatgggagtggggagcggggatgacactggactctgggcctccacagttcagaggcgcttgggtggcattagagagatggagaagggggcggcatgaggctcaaatgcctgctttgggtgtgtgagctccagagaaggccaaggctcgtcactgagagcccctgtggccatgaggatccccctgctccaacctgcccccttatgtgagtcggtgggaggagctccccggggaaggcggccatgagctccagtgcctcctgtcagggggcttcgggccagaggacatctgggttccagctgccagagccagaccaccctcagaccacagctggctggggcaggctgctcatggcaggggacaggtggccccaacagcctgtgttcacagtggagcccgtggagtctcactctcctttcctgggtcagtgggcttcacagggctggtgtttacagcaccccctccaaggcaggggcagtcccttgtgacttccctggtgaccactgtccccaggattgcctggcgcctgcctcaccccaagaaaccctggggtgctgcctgcctaaactgggccttgcgtggaagccgtgctacgtgccctaccacacagtgtgtccgctatcagctaaagcacctggagccgcaacagcggttggtgattcgtcaacatccacagagggcagagcgtggaacgtggcttaagggagccactgagtggccacagaggagtgtccaggagctcagggtccacgtggagtcgatgaggacgggcttcagctccagctcagccacttagcatctgtgagttccaaggcctgagcctgatgcctcatgtgtggaatggggacgctaatgtccctcccacctctggtgaggctctagggagaagctattgccttggccaggggcagaagccatggcctctgagcagctcaggacagggacagtggtcgggacagggacaatcactcacagggtcaggctctgccgagcatgccgcgggctcccagggcacccctgttcctgcctgattccacctgtctcttgatcctgtgtgtggaatggggccacaggccggggctgctctcaaagaccccgtatttgtccattcttgtactgctgtaaacacctgagatgattatttatttatttatttatttatttttgagacagagttttgctctcgttgcccaggctggagtgcaatggcacgatctcggctcactgcaacctctgcctcttgggtccaagcaattctcctgcttcagcctcctgagtagctgggattataggcatgcgctgccacacctggctatttttgtatttttagtagagactgggtttctccatgttggtcaggctggtctccaactcctgacctcaggtgatccgcccaccttggcctcccaaagtgctgggattacaggtgtgagccaccatgcccagctgatggtaatttattaaaagaggtttaattggctcacagttccacaggctgtacaggaatcatggtgctggcatctgcttggcttctggggaggcctcaggaaacttacaatcatggcggaaagtgaagagggatcaggcacatcacatggccagagcaggagcaagagagcaggggatggggtggggctgacgggtgggtgccacacgcttctaaacaaccagatctcatgagaactcactctacagtaccacgggggagggtgctaaaccattcaggagaattcaacctgatgatccaatcagctcccaccaggccccacctccaacattggggattgcagtttgacacatttggtggggacacagatccaaaccatatccgaagtggactcatgggggatttggagtgactcaggagctgtccctgtttggggtaccttctttcctgccctttcggacacagttgagggatagctgctggaggcggttccctttgccttccacacctattgctggtgtgactgctggcccactctccacttgggagactaaggtgacttcttcctgggtccctctcagcccccaggtggggctcctcccaggcagaagctttctgtgccaggcacttgctagctggtggctttgggcagcttctctgtgcctctcagttcacccatccattctatgggggtggtaacaggctggtgaagatggaatgggtttgttccagagctcaccagtacagtcagttctctgttactgctgcccccagggcacatagtaggtgttcagtgagggccaagattgagggtggagtctggctcacacctgcaaacaggggctacctggtgactaactccttgtctgccctgccggcacctgcgggtccccttcctcctctgtgtcttttcccaggtgcaagtgcaacgggcatgccagcgagtgcggccccgacgtggcaggccagttggcctgccggtgccagcacaacaccaccggcacagactgtgagcgctgcctgcccttcttccaggaccgcccgtgggcccggggcaccgccgaggctgcccacgagtgtctgcgtgagtgtctgagtgtcacagggcatcagggacccgaggctggtgttgcaggcggggaaaggaactccccaaaacgtcgtggtgggggctgctcctgggtacgccccgggggcagctcggggtctctgtgctgctgcagagataaggacgagcagaaggggagcctggggagggggtgcatttaagcctcagtctctcctccactaagtagcttccctggaccaactctacccatgcagaggcgcctgtggtgggagggccggaaggtccccgacttgcttctttgtgttaaccgctcccaccccagctgctaatcggaaccaggctacccaacaagcaagggggtgctgatggcccacccagcctctcccacgggcccccaggcagccctttggtgtcccagcccccatgtgatgtggctttgaccacctaacctcagagaagcgctggagagaggatgatgccatcatgtcttctccagggacacaggccaagagcagggacccactgacttcccttctggctggggcactggctgcaagccccaccctgtccccagacagcctggtttcctccaggctctccatgcacagccgccgttgctgggggccagatcccagctggtgctggtgctgctggcaggagacacatcttcactcacaggctcgctgggcgggcagcttggcctctggaccccgctgtcctcttgggcctgggccactggcgaccagaactggggctgggccgggggcggcttgttctgagggtggggcactgtctgcaggagctgccctcgctggcctgcctccaccagagagtcctggggccaaggaagctgtgctggctggcttccactgtcccagcctgctgctgtctccatggtggggacacagaggccagactgcttctaccatgtcctcagctccatggtcacgtctgtctctcagtcagcagcctgggagccagggtttcaggcttgacccttcatccccaccctcacccgcagctgagacagccccgagccctgaattccgcctcatccacatcgctccagtctgtctaacttctgtccattgcagccgatgccttgggcctggccctgcctcctctccctgcacacccgaagcttcctcttccctgctctccctgttcccagccctcccctaactgcagctaaggctcttttcttgaaacacggcctcactctgtcacccaggctggagtgcagtggcccaatcatagctcactgcagcctcgaattcctgggtgcgtgttcctcctacctcagccactagagtagctgagactacaggcacatacatcaccatgccaagcaatgttttatagagctcggctctcactgttgcccaggctggtctttacactcctaggctcaagcagtcctcctaccttaccttccaaagtgctgggatcacaggcgtgagccatggcactgggccaagactttctaaaggacaaatttagtaacatctattccctgcttaaaccttcccacggctccccctttgctcccagctaacgtccactgaccacggcagcccagcctccctggagcaagctctgctagcctctgacttcacaactgcccctgcactgcaggccccccactgcacaaagtccttccttccctgccatcacacgacatgccgtctgcagccagcctcatggcacacccgcaccaggccacgcgtctgtctctgcatgtggggtatcccctgggctttcgcctcctgtctgcgacgcccttcccgccccctcttcctctgcctggcctattcctcactgctcagccttcagattcagcgcggccatgacttcctctcggaagccttgtcccaccaccccagcacagctgcaggggccccttctttcggctcccaaagcccccagcctctcctgtctcagccctgcacctgcagggggtttgcttgcttgccgtctgggctgtgggcagcacgagggcggcaggtgtaaatgggtccgcacctttcatggatccacccctgagctcactctgggagccaagacagagccagtcctgcacacagacttttaaaaatgatttaatgggggaaatgaaaggtgacttgtgctttctgtacccctgagtgacctcacacaatagtgagagtcacactattatggcttggaggacctccaggagattttggagagagccaagctgccactccagaaggcagccagcctctgatcggtgcccatctatctgggtgtatatccttgttgcctgggatggtcttctttctgcctgttgttttggtgtatttactaacagtgtcccctttgctcttaagagtgtcctgttttggaaaatcaattgatcaatgtctagccttgatcaagctgggcctgaactccattctggaccatgctcttgcccttctctttgcactgcctgctcatttagcacagggaggctgactgacacagatgcagcctcctaccacatcacaggggactcacacacctttccccactcctgcccatagcctgcaactgcagtggccgctccgaggaatgcacgtttgatcgggagctcttccgcagcacaggccacggcgggcgctgtcaccactgccgtgaccacacagctgggccacactgtgagcgctgtcaggagaatttctatcactgggacccgcggatgccatgccagccctgtgactgccagtcggcaggtgagtggactccacatccccagcctccgaccctctccctttcctggcctcaattgccctgtgcccttcctctcccaggctccctacacctccagtgcgatgacacaggcacctgcgcctgcaagcccacggtgactggctggaagtgtgaccgctgtctgcccgggttccactcgctcagtgagggaggctgcaggtgagggcgaggggcggcccagtatggacacattgcactgaatgacaagaagcaggaggaacaggctgtcagcagtccctcccctccccatcccttcctgtctgcagctacctcgccctaatcctggtgaagactagagacactcagctcctggagaggccaagagacaaaaacagaccttaatgagaccaggctgagccctgtggaagctcagcggatcttgcaggtggagggcaggcttcctgtaggaggtgctgcataagtgcagggagaggggaaggacaggtgtttgaggtggggtggggggcacgggaggcctctggaggagccgtggatcagtgagaagcaggagtgggtgagggggaggctgcgtggaggctacagcaggaacgcctgggcagcctgcatgggggtttgactgtggagagggagagcagggcagattccagagcccagtgcaaggaggagctaataggacatggtgaccagggggtggaagaggaagaagaggtggaggctgaccttcggggttctctgggcctctggatagcagggcacgcagtgtggggagcggggtgggagaggctgagtgtcatctgggtgcaccgagtttggtacctagtgggacagctgaggggagagagggacaggggctcctggggtctggaccttaccccaacacatttgccatcacttgattgagaaagtatacaatggccaaaaaacaaaaacaaaacaaaacaaaaacctatgataaatttagaagctttttttttttttttttgagacagattcttgttttgtcaaccaggctggaatgcagtggtgccatcttggctcactgcaacctccacctccccggttccagcaattctctgcctcagccttctgagtagctgggattacaagcatgcaccaccatgcccactatctctatttttttttttaagatggagtcctcctctgtcacccaggctgaagtgcagtggcgcgatctctactcactacaacctccgcctcccagactcaagtgatcctctcatctcagcctcctgagtagctgagattacaaatgtgcaccaccacacccggctaatttttgtattttttggtagagatggggttttgccatgttgcccaagctggtctcaagctcctgggctcaagtaatccaccctcctcggcttcccaaagtgctgattacagacgtgagtcaccgcgcctggcccagaagcacttttaagtgaacttgctttggttgataacgggcatctttgtatatttgagaggcagcagaaacacattggggatatctaggagagctctgattccttgtaaaatatttggtggttctgggcataaaactgaccatgagatggggcctggctgcttccctggggtccctctgtcctctggacctttgcaggtgccacacctcccacccctgccccctctccccagcctgtggctcacagcctcctgctcattcttcaggtctcagctgagcagccccgctctcgggacaccttccctcccacctgcccctcgcctgcacacccaggctgagtcagaggccccacagtgcaggcacagcctctcgtacatctcccacaacacgtatcgcggtacagggtctgcgtgatctgtctgtctacaccagactgggattcaccagggaggaaccatgtcttattagatgagtggatggatggagggagggatggaaagatgcatggatgggtgaatgaatgggtggataggtggctgctggacagaaagaaggaaggatgaataagtggatggaggagtgaggggatagacagaaagattcatggaggccgagcacggtggctcatgtatgtaatcctggcactttgggaggccaaggcaggtggatcacctgaggtcacgagttaaagaccagtctagccaacatggtgaaaccctgtctctactaaaaatacaaaaattagctggacatggtgatgcatgcctgtagtcctaactactcaggaggctgagacaggagaatcacttgaacccaggaggcagaggttgcagtgagccaagatcatgacactgcgctccagcctgggtggcaaagtgtgactctgtcccaaaaaaaaagattcatggatgatgagtgagtgcgtggatgacagatggaaggatcctggatggatgtgtggtgggtgggaagatggaccactgtaccagtgatggatgggtcacttccttggcaagatgggaacagtaaagccaggtcagttacctgcgtcagcctcactcctgatgttggcagcagggaaagctcccttcctaggatgggctgttgccattctgaatttgctcattgcacattttcctcttgtcctgtctcattggcagaccctgcacttgcaatcccgctggcagcctggacacctgtgacccccgcagtgggcgctgcccctgcaaagagaatgtggaaggcaacctatgtgacaggtttgtgagctaatccagcagtaagcttgctggaagtgacctgggggctcactgatgaggcaccaaagctgtggagtgcggggaggagcaaggggcacggtcttcatggacttgggtgaccttgtcaccctgtgcccttcctggggcaccatgtatctgtcatacaggaagttactcaaaagctttatggcactgtttgtgctttgattcaacaccactgatcattcataagctgagaaaatacatgtcttagcttagaatcctgaaaagaaagaactggaatgataggagagaccatctaatccagggatagtaaatagatggtgctcgtactaccacctgctgtggcagacatcgctaatggagcactatcacaggcctcccgtttcacactcactgcagacatagctaatggagcactatcacaggcctcccgtttcacacccacagcagacatcactcatggagtattatcaacgctcccctttcacacccatgacagacaccactaacggagcactatcacaaccctttcacacccacggcagacctatcacagccctcccttttcacactcaatagacattactcatgcagcactgtcaatacacccctttcacacccacagcagacatcactaatggtatacccatggtacacatcactaagggagcactatcacagtcttcccctttcttacccacagcagatatcactaatggagcactatcacaaccctcccttttcacactcacggccaacatcactcatggagcattgtcaatgcacccctttcacacccacagcagacatcactaatggtataaccatggcaaacatcactaatggagaactatcacagcctccccctttcatacccacagcaggcatcactaatggagcactatcaacccttgcctttcacagccatggcagacatcactaatggtgccatatcaaactttccctttcatagccatggcaggcatcactaatgaagcactactacaacccttctttttcacacccatagcagacatcattcatggagcactgtcaacacacccctttcacacccacaacagacatcactaatggcatacccatggcagacatcactaagggagcactatcacaaccctcccctttcatacccacagcagacatcactaatggagcaccatcaactctcccctttcacaccatggcagacatcactgatggcatacccatggcagacatcactaaggcaacactatcacaaccctcccctttcacacccacaacagacatcactaatggggcacagcagtcttggccatgagccctactataacctcaggatccttcttaacaccctgcttcaggaagcccctacccactgagctggattttgagcctgtttgccatctttgcagtctgatcatggtacaaatggggcatctgaagctctgcaagtcaaaggggctctcccaaggccaggaagtacataaacttcctctttcaagtgttcaagaggcctccaagctccagcagtgcggccagcagacaaacatgggtttagctccttgggtacacactatctcttcttcctggctttgtgtctgacattcaccagagctgcttggagaagtggcagattctggggctggggctggaaaaagacaagataagcccaaggcgtcttacagtgccaggaagcaaggaaatgctgaaaaacagagacagacacaaacaaaacagcccaaaccagaacgtgggcccatgtcaaaaggacacaggagccgacgtgaaagagctctcagggctgaaacaatttgagcaacaaaataaacgatagtattggattataacccagagaataaagtcaaatccacgaatccatactgatgtaaatagatgattgaatacataaatagatgggcatgaagagacaaaccttccttgcagaagaattccaagtaatgaatgtagaaatgaaggaactggaaaaccactgttcagacctcacagtggtaattgctacaggcaagagctgccgatgaatgctgacattggtgggcagaactttaaggaaagagaggatatttgcataacctcaaaatatctattaattactggggtggctttaacatctgtccgtgggttctttgatactcttcctctaggaggtcgagcttaatccccctctttttgagactgggctgcatttagtgacttgctgcttttttttttttttttgagacggagtttcgctcttttgctcaggctggagtgaagtggtatgatctcggctcactgcaacctctgtctcccgggttcaagcgattctcctgcctcagcctcctaagtagctaggattataggcacccaccaccacgcctggctaatttttgtatttttagtagagatggggtttcaccatgttggtcaggctgatctcgaactgacctcaggtgatccacccacctcggcctcccaaagtgcgtgagccggccaggcgcggtggctcatgcctgtaatcccagcactttgggaggccgaggtggatggatcacgaggtcaggagttcaagaccagcctggccaacatagtgaaaccctgtctctactaaaaatacaaaaattagccgggcatggtggcgcacacctgtagtcccagctacttgggaggctgaggcaggacaattgtttgaacccgggagacagaggttacagtgagctgaaatcgtgccactgcactccagcttgggcaacagagcgagacttcgtctcaaaaaaaaatttaaagtgcttgagccaccgcgtccggcctattcagtgacttgcttctaatgactggaccgtggtgattgcacagtggagagactggtagacagcacaggtgatgaaagtcagcatcgcttggatgtcatgtgggtttcctgtgcccccatgtgatatgacgagaagggtacttcacctctgtgtatttctttcccaagcctataactctggtctaatcatgagaaacatcagacattctaaaaatacctgatcagtgcttttcaaaaagtgtcaagatagtggcagacaaggaaagactgagaagcggtgataggttggaggagaacaaggataccactaaatgcaacaccgtgtcctggatgggatcctgcagcagaaaccagacattagaggaaaaagtggagaaatcctattaaagtcgctgggcgcggtggctcaagcctgaaatcccagtactttgggaggctgaggcgggcggatcccctgaggtcaggagttcgaggtcaacctgccaacatggtgaaatcccgtttctactaaaaatacaaaaattagccgggtgtggtggcaggcgcctgcaatcccagctacccgggaggctgaggcaggagaatcacttgaacccgggaggcggaggctgcagtgagccaagattgcaccattgcactccagcctgggccacagaacaagactctgtctcaaaaaaaaaaaaaaacaacaacaacaaaaaaacaaaacctaataaagtctggagtttagttaacttagttttgacaaatgtactgtggtaatgtcagatgtcagcatcaggggaggctgtctgaagcaggtatgggaacaatctgtaatgttcttactactcttctagaattctgaaaaaaaattgtttttaagtttctgcagtgattctagactctcattggtccagctgggataccctggccccgccccttcctggctgattcacgtggccctcgtgggcatgtcctgcctccatttcagatgtcgcccggggacctttaacctgcagccccacaatccagctggctgcagcagctgtttctgctatggccactccaaggtgtgcgcgtccactgcccagttccaggtgcatcacatcctcagcgatttccaccagggtaagagatgctccctgcaaacgcctcccaagggtctgctcccagcctaggcaggtgatcctgccctggggagatcttgcattagtggatctcccattgtggagaggagccacaggcctgcacagcctaggtggggtcgggggtgagatgatggctccccagtgcccacctgcgacccccagctccctccccagtccctgactcttctctttatacccgtggtggggttgggggccgggtacgtgacgctttttggatcctgtaggggaatttcccactcaccccgttgagactggcctcccttggtgtgtctaaacactggggattcaggctcagtctcctggcctccacttattgagcacctgctgtttgccaggcactgtgctgagcacctaacatgcaaggattctcattcccctttcaatgatgaagtaactgagacctacaaaaggtaggccacttgcctgaggccacataacagttgtgagcactgcatttgtcagctcctgagttttgctcctttttttttttttttttttttttttttttggacacagggtcttgctgagtcaccaaggctgaagtgcagtggtgcaagattgcacagcacagctcactgcagccaccacctccctgggctcacgtgatcctcccacctcagcctcctgagtagctaggaccacaggtgtgcaccaccgtgcccggctaatttttatatttttttctaaagacagggttttgccatgtctttagacccaggctggtctcaatctcctgggctcaagtagtctgcccacctccgcctcccaaaatgctgggactacaggcgtgcaccaccatgccgagctaatttttgtattttttttttttttttttttttttttgtacagacggggtcttaccatgttgcccaggctggtctagaactcctgagctcaggcaatcccgcccacctcggcttcccaaagtgctgggattatgagtgtccgcgcccagctgttttgcccttaaccgctgtggtggcctataccgtggtccctgactccaggtggcacagccgcatatttaaagaggaaagcagcagagctcggagctctgcattaaaccagaggctgcgtgggccccagcgatgtcccacggagcgccccgcaccttccgcctgtccccaggaaggagcgaggcatcagctgaaacagaagaacctcagggccgacgctggggcggccccagacatgagggccgcgcgccctctgctggaagccgcgcagaaagcaggaccgagagatgcgcggaccggcgccgcgtgtctgggtcctgggtccgggggtctagggtgtcagcgttgggcaggactcattttctagaccctaagaacagtgtcatgatctgttctcacattgggccaggcactgggtgtggccggcccttcaggggtgtcatctcattttgtctcacagttgcccttgcgcaggagttctcaaaactttttggtctctgaattcctctttttttttttttttttaagacggagtctcactgtgttgcccaggctggagtgcaatggcgtgatctcagctctctgcaacctccgcctcccaggttcaagtgattttcctgcctcagcctcctgtgtagctgggactgcaggcacccaccaccacgcccagcttatttttgtatttttagtacaggtcgggggtttcaccatgttggtcaggctggtcttgaactcctgacctcaactgatccaccctcctcagcctcccagagtgctgggattacaggtgtgagccaccgcacccggcctctggatccctttatgctcttgaaaattattgagaaccccaaagtgcttttgtttatgtgggtggtttgtatggatatttgctgtcttagaaatggaaactgtggctgggcgcagtggctcacgcctgtaatcccagcactctgggaggccggggtgggggtggggggagcggatcacctgaggtcaagagttcgagaccagcctggccaacatgacgaaaccccgtctctgctaaaaatacaaaaattagccaggcgtggtggccagctcctgtaatcccagctactcgggaggctgaggcaggagaatcgcttgaacctgggaggcagaggttgcagtgagccgagatcgcgccactgcactccagcctgagtgacagggtgagactctgtctcaaaaaaaaagaaaacaagtagtttttaaatttttattatttttatttatttttattttatttttttagcagagacggggtttgccatgttgaccaggatggtcttgatctcttgacctcatgatccatctgcctcggcctcccagagcgctaggattataggtgtgagccaccacacccagctgatttttttttttttttttttttttttttgagtcagagtcttgctctgtcacccaggctggagtgcagtggcacaatctcagctcgctgcaacctccgcctctcgggttcaggcgattctcctgcctcagcctcctgagtagctcagattataggcagctgctaccatgcctggctaatttctgtatttttagcagagatggggtttcgccatgttggccaggctggtctcgaacttctgacctcagatgatccacccacctcggcctctcagagtgctgggattacaggcatgagccactgtgcctggccttctagttccttctaaatgcctgtctgcaaacttctcttcatgttgacatcttcctttctctgacctctttccccactccgttccttccttcttaccccttggctgccccaggtatttggcctctgcctcattgcccgctaccccctggagaggcacctccttaaggtcactcgctgtgtgctgggctgtgctccgtgttaactgctgtggccagagggaggaggcactgaactggcactggggaccagaaggcctgggctcccgtcgtggctgggccccttcctaaccaggtggcctccttgcctgaggtgctgttaatgacatgggccactggaaggacagggttcatgaggtcacaggtgagaaagttctctgagaacctgaagatgaggtcaagtctggtactattagagatggccctgatgtcccagggcccccatgtgggggtcttcaggctgtcttcatgctgagctcaaaaccccactgaaagggcagggcaggcttccaggtctgaccatgcccccaagcagatccgggtccctgagctttctagcttctcctggggctccctcctaccccagggcccccacctggggctggcacctggagaccaccctccggggcctcacactgatcggggggtgtctgtgtttgctgtctaggagccgaaggctggtgggccagaagtgtggggggctctgagcaccccccacaatggagcccaaatggggtcctcctgagcccagaagacgaggaggagctcacagcaccaggtacctccagcaccaggtgggggctggccgccctgtgtcggttcctcctgctgctaaacaacttgccgcatattagaggctgaaaacaatgccagtttattctcttagagttctggagaagtcagaaataggtctctcggagctaacatcaaggtgtcagcagggctgagttccttctggaggcccatgggaaagtcccttccttgcctttcccagcctctagaagccgcctgcattcctgggctcatggcctcttcctccatcttcaaagcagctgagtttttctcacgccccatcactggcaccaactcccctgcctccctcttgtgtatttgccattaatctctaatgattgatggggcccagctggataacccaagaggctcttcctacctcaggtcagctgattaacaaccttaatgtcccctgccacagaacacaccatatttatggattccagggattagaatgtggatgccttgggaaggctgttattctgccatcagaccaccgtatctgatgaaacccccgtttttctggtcatagctttgtcatggagggcttcttcagtgccacagggccatagccactgtcatggcccagagaatctgtgtttcccatcagcccctcacccgccaggccactgcaccctaagcccagggccatggcattcttgcaaaaggaaggaggttcttgatcattctgacctctccaccccacagtgaggggaactgtggtctcctggcgactgtctcagccccagaacccagagcctagagcccatctttagccccactgtggctgattcaggacctgccagcacccccgaccagctctgccctttccctccctccctctgccagagaggccggggagatgatgtcacaggtggctgaggagccgtgtgccctgcagccaggaagtcaaaggcgtcgggcccctcgtggggcaggcgctccaagctcagaggcccatgagcaaaaaactcactctgttccatggccactctgctggcatatgtaagaaaaggggcttattcctgaaagaagcgcttgctgggtgttgggcacactgcaggggtgagatggatggacggcctgtcctcatggtgctctcaggccggcccgctcccggggcaccctgagcagctggaggtgagggcatggcaggggagccaggcttctgcctgttgcttacggtggggacacagaaacaaacgtctgggctggctggtgacagcatcagagggaatgaacacatcgaccctctggccagcatgtccaccttctgtattctgcctacgagcactcagtggggcaaagagcaggagctgagggaagataagtatttaggccgagcgcaatggctcacacctgtaatcccagcactttgggaggctgaggttgggggggatcttctgaggtcaggagttcaagaccagcctgaccaatatggtgaaacctcgtctctactaaaagtacaaaaaagttagccagacgtggtggtgcatgtctgtcatcccagctactcaggaggctgagacaggagaattgcttgaacctgggagatggaggttgcagtgagccaggattgcaccactacactccagcctgggcgacagagtgagactccatctccaaaaaaaggaaaaaaaaaaaaagagtatttaatggtgcaagcttggggcagtcccaggaggggctgggtagcctgttggtggactgtgatgcggccggttgtggaacagtgtgtgaaaccatctcacgtgtagaacgtgagtagcaaaggatgggaggggagcattgcgctcgtgctggtgattgattctggaggccgaatcggagtgcagccggggcatgtggccaccagctcccggggctccccgcttcaggccgcttctgcacaggtaagaaattcccccagccaggaaacgctctggggcagagggacacagggactttcagtgtttcgggagctgtccaccaaagctgtggcggggcgcgctacagaatttgagggatgcactgcagaattaaaatcccacccccccagttcccaaatagggggaagtactattaaaggtactaaaatataaacactttttttcccctgcagttttgccctttatttgtcatggtgttttttggtttgctatttgatgccattctaggtaaaggaaaattttaagttattagcatgaaacatataaagttattagcatgaattttaccattctttttttttttttttttgagacggagtcttgctctgttgccaaggctggagtgcattggcgtggtcttggctcactgcaacctctgccttctgggttcaagcaattccctgcctcagcctcctgagtagctgggattacaggcacccaccaccatgcccggctaattttttgtatttttactagagatggggtttcaccatcttggccaggctggtcttgaactcctgaccttgtgatccactcgcctcagcctccaaaagtgctgggattacaggcgtgagccacaatgccaggctgcgtattttgttcttacgaggacagtggaaatactgcacacaacaagcccagccacttttatttcactccttgacacacgcatgttccaccaacatggcacacctctgtggctttctcacgggtaagggaaagaccactgggaaaggaggagggagggtactgggaaaggaggagggagggtggcctgtgtcctttcctcctgggtcacgaacttctgaagaaatgatgggctgatgcagtgaaatgacatgagtcagaaggtaccgcacagcgcttggtggttcgtgtctcagaaaactagtgccttctttccgagttcagggcaagttctgattggaagggaaagcatggcccggggcccagagcacctctgctcactcagccagctcacttaccttgctgtcacctggaggtcccgctaaactcctgctgctgggtgttccctaggaatttcgtgctcatgggcatcgtgaatgctacacatgagcagacggcagcctctctggtcacacgtgtgtgtatcccctccgttcaccctcggactccgtgttccatcggacgtcacttctaaaacccaagttcaaagataaaattattaagaatgtgaagatggtcacagcagagcatgaagccaagtgtgggggcgtgtgtgactgcagaggtgtgggtgggccccctgcagggtctgctgtgcaggaagcttttgattttctacccactgcacttttatcttttttgaatgtttagttgccgataaaatcaacatagacatttaaaatcaagctaaccatatgaagactgtcaaagccttcttctcttgtcttcagagaagttcctgggagaccagcggttcagctatgggcagcccctcatactgaccttccgggtgccccccggggactccccactccctgtacagctgaggctggaagggacaggcttggccctgtccctgaggcactctagcctgtctggcccccaggatgccgggcatcccagggaggtagagctcaggttccagtaagtatccccttctgtcctgagagatggggaggtgagaggggtggtctctgaggtccgggcacatttcagatgcccctgtagtctggggggctaccccccatccccaggcatggtacccccccaccctatgtcgggatctcactttgaccgcttctctcgccagcctgcaggagacctccgaggacgtggcccctccactgccccccttccacttccagcggctcctcgccaacctgaccagcctccgcctccgcgtcagtcccggccccagccctgccggtcagtaaagacaaccacatgcccaagacccgagtgcttgccaggtctcagaactgggctgggctccggcggtcacagtcttgtcagggccttgcggccgggtggttattgtcctgttttgccaagaaggaaccttagtcaaaagtcaggacagttgccagaggccatataacctgtgaaggcaatggggatggtggctgaggtcagatgcagggaatggacaggagagaggcctgaaggatgggcctcagaggcaggtgtgcggccagcaagccacccagacccgctgggtgtgctcactccaccttcactggatccaccaagccccctgtccccgctggacacagcccacagccggcagtccaggagtcccctggcagagtgactcccctgctggtcactggcggtattgtacctaagccaccctaggagggtctggtcttcccaaagagggggccaagccatcacacatcattgatgggggtctgtcaccacctcccaccctggtcacagtgattgacagccttagcctctgatctgttcctcattagaacctctacccacacgctattttaaaaatcaatataggtcgggcgcagaagctcacgcctgtaatcccagcactttgggaggccaaggcgagtggatcatgaagtcgggagtttgagaccagcctggccaagatggtgaaaccccacctctactaaaaatacaaaaattagctgggcgtggtggcacacacctgtaatcccagctacttgggaggctgaggcaggagaatcgcttgaacccaggaggcggaggttgtagtgagccaagattgcgccactgcactccagactgggcgacagagccagactccatctcaaaacaacaacagcaacaataacaaaaaacagtctggtggggtggtctgcacctgtaattccagctactcaggagactaagactggaggatcgcttgagcccaggaggttgagactgtagtgactgtgccactgcactccagcctgggtgacaaagcgagaccttgtctctaaaaaaaaaaaaacaaaacaaaaaacaaaacccctagtgtatgtgtgtaaaatgaagctgagctctaggctcagatgtttacaaaggggtttttctacccttccagcaccacgcaggacatttgaaagtcatgtggggagtttctgggaatgtcaatttctgggaactttaggcctcttcatccacatgacaaccaacatgtcctcagatttgcttccaggggagggagattttgctctttttgaggacctctggctcagagggtcagtcttcccctgggcctcttttgagtccaagggtgctgggatgccctggagaagcagaggacatagcgaccctccccagcacccgcaatccccaaacttcctctttccatgggtaatgttttgggaggcctctctctaaacctttctgtgtgtacgtacttaacatctgtatttttttaaaaacatagaaatgtgattacacagccgggcgtggtggctcacgcctgtaatcccagctctttgggaggctgaggcgggcggatcacttgagctcaggagtttgagaccagcctgggcaatatggtgaaaccccatctctactaaaaatacaaaaattagccgggtatggtggcatgtgcctgtaatcccagctactcgggagggagaattgcttgaacctgggaggcggaggttgcagttagccaagatcatgccactgcactccagcctgggtagcagagccagaccttgtctcaaagaaagaaagaaaaagaaagagagaggggaagggagggggagaaagagagagagagagtgagagagagagaaagaaagaagaagggagggagggagcaagggagggaaaagaaaagaaagaaaggtaatcacacagtacgatattctgggacttgctttttgtcagctaacagtgcgtcgtggaggttgttccttgtcattacgcgtagaaagcctggttttctgtgtctggtgtgtaagattctgtggtatgggtgctctgtgaggttttagccatccccctattgacaggcgcttaagtggcctccagttttccccattacaaccgtgtcacagggaatagggaccagcctcatagaaaggtcttggtattccagtataagtgtcgctttaggacagagtgctggaaatggagatgttaggtcaaagagggagcattttccattttgatccacactgccaaattttccttcagaaaggctgctctgatgaggagtgtcggccgcctccagtctccctgttctgtgtctacagatggtcattttcatattttgcccagagtttatagttgttttctgtgggaaggttgatctgccaggatcccctgctcctctgttactggaagcaaaaccttctgattagtattcgtacatccacactcttttttcttttctttctttttttttttttttttttgagacggagtcttgctctgtcacccaggctggagtgcagtggcatgatctctgctcactgcaagctccgcctcccgggttcatgtcatcctcctgcctcagcctcccgagtagctaggactacaggcgcccgccaccacgcccggctaattttttgtattttttagtagagacggggtttcaccgtgttagccaggatggtctcgatttcctgaccttatgattcgcccgcctcagcctcccaaagtcctgggattacaggctcgagccaccgcgcccggcccatttttttttccaaatatcagatttctttatttttaaaatgtacacattatagttgatctaaatacaagatgttcactttccttgcaggtaagaaatgtcactgacatttctgtgtcaattagcttcttttacatcaaaatcctgttacattcattagtctcaaaatctcctataacacttagaactttaggctgggcgtggtggctcaagcctgtaattccagcactttgggaggctgagacaggagtccttgaggccaggagttcaaaaccagcctggacaacaaggcgaaaccgtttttctacaaaaaatttaaaaaattagctgggtgtggtgccacacacctttggtctcagctacttgagcggctgaggcaggaggatcatttgaggccaggagttcaaggctgcagtgagctatggttgtaccactgcactccagcctgagtgacagagcaagattctgtctctcttaaaaacaaccaaaacaacaagaaaaatcttaaaaccttagaaatagaccttaaactttgcctaaatgtagcattcagttatgagtagcccaggtgagtttcctacacgccatcctccactaaaattcatctataaaatgttaccagtctgagagatgtgaatggtatcatcgttgtttaaatctatatatcgttaataacctgtggatggatatctttccataaaattctcagccatatctatttcttcttgaaaattgcctaatcatctcccttacccttgaattgacaatttgaaaaataaaaataaaaatcaaccagcgcagtggctcacacatgcaatcccagcactttgggaggccaaggcaggaggattacttgaggccaggagttcaagaccagcctgggcaacatggagaaaccccatctctacaaaaattttaaaaattagctgggcttggtgtcttgcctgtagtcgcagctacttgggagggtgacatggtgggatcactggagactaggagtcgaggctacagagctatgattgcaccactgcactctagcctgagtgacagaatgagaatctgtctcaaaaaaagaaaaatcattgattgctagtctgcctttatatacgtgggcctggtccatatgtgaacaggaaggttttggggggaagcatgtgcagggagcttgtgcctcctctcttcctctctcccttctcgctctgcaggtccagtgttcctgactgaggtccggctcacatccgcccggccagggctttccccgccagcctcctgggtggagatttgttcatgtcccactggctacacgggccagttctgtgaatcctgtgctccgggatacaagagggagatgccacaggggggtccctatgccagctgtgtcccctgcacctgtaaccagcatggcacctgtgaccccaacacaggtgagtctcctggcaccccatccgaaggcacctgggttatacccaaaacagcgggatgagtactgacctgaacagggccagcctggcacaggcattgaggtgttggccaagctgtggggcagtgcgggcactgagctttcccgtgctgctcagtgcctgggcacctcatagtttaataaaagttactactggaatttgttgaagcctcaggctctgtgccaaggactttgtatgtatcaggtgataaccataagccagctgctctgtgggccatctgtccgcgccaccttctccctgggctggcccttttcccaggaaggaccagggaaagacctcaggggtctttacatgcagagggtgctgtgaggaagggcagaggcaccagcatggcaggtgacagcaggagggttctcaagaaggtcacacaggtgacagcagctcataggcaccaacccagaaccacagacctgccaccctcaccccttagtggccatgggaaagtcacttccctccctgagcctgcttcctcttctgtaaggtggagataatgacagtatatacactgcttctgtttctacacaaagccatatggtggtcaggagacgctcaggctctgaaaacacaggcctgggttgcataggagctcagccatagctaactgggaatgccttagggaagcgcagataatgaaagtctctacttttcaggacacttgggaaataataaaatagtgtcaccaggttcctgcatgtgctagtcaccttctctacactatatcattgactcctgcagacatccctgcggggccgggacccttcctgtcccatctcacaggtgaaggccccacgctgcagtgcagatgcatggccagcaggtggcagagccgtgcctccctccagcctggactcctgaggcctggttgctgctggctactcattctcacttctttttattttattttatgttttattttttattttttgtggggggtgacagagtctcgctctgttgcctatgctggagtgcagtggtgcagtcttggctcactgcagcctcctgctgggttcaagagatcctcccacctcagcctcctgtgtagctgggattacagacgcctgtcaccatcctcggctaatttttatattttcagtagagatggcgttttaccatgttgaggctggtctcaaacctctaacttcaagtgatcctcctgcttcagcctcccgaagtgctgggattacaggcgtgagccaccacgcctggccaactgatccccacttttataggagcagacctggccttgctcaaggtcacatggccaggaggcacctgagaaggctggactcagacctcttccactcccacactgacggcttcatgcctagacacctgctgcctccccagagcaggtgggggctgtctgagaagaaggctgctgggcatttttcttcctgaaaagacggtagccaggcgtggtggctcacacctgtaatcccagcactttgggaggctgaggtgggcggatcacctgaggtcaggagtttgagaccagcctggccaacatggtgaaaccccatctctactaaaactacaaaaattagctgggtgtggtggcaggcacctgtaatcccagctgcttgggaggctgaggcaggagaatcgcttgaacccaggaggcagaggttgcagagagccgaaatcatgccattgcactccagcctgggtgacaagagcaagactccagaggaaaaaagaaaaaaaaaaagaagaggccagacttgggctcatgcctgtaatcccagcactttgggaggccaaggcaggtggatcacctgaggttgggggttcaagaccagcgtggccaacatggtgaaaccctgtctctactaaaaatacaaaaattagccaggtgtggttaggtgcctgtaatcccagctacctgggaggctgaggcatgagaattgcttcaacctgggagatggaggttgtagtgagccgggatcgcgccgctgcactctggcctgggcgacagagtaagactccatctcaaaaaaataaaaaaaggccgggcacggtggctcacgcctgtaatcccagcactttgggaggccgaggtgggcagatcatgcagtcaggagatcgagaccatcctggctaacacggtgaaaccccatctctactaaaaatacaaaaaattagccaggcgtggtggcgggtgcctgtaatcccatctactagggaggctgaggcaggtgaattgtttgaacccagggggcggaggttgcagtgagccgagatcgcgccactgcactccagcctgggcgacagagcggactccgtctcaaaaaaaaaaaaaaaaaaaaaaaaaaaaagacgtcagctgacctagccggggagggcaagcacaaccacacgccacacgccacatacagggcactctgtcttcttgtgtccatggcaagcattgataatcgagcccagacaaggccacataatccctccctgctgcagtgcttcctgcagcccctgtggaggaagcagggtcctcccatgactgggatcagtttgtcatccccacagagcctctggccctgccacaacttcctgctcagcttgggcaagtcctcatctgtgaaacgggcagtatagccccgctgcctaggctgagaggaggaatgagcctatgggtgctgggcctaggctgggacagttccccctggatgccagccctgctatgcatgagcgacctggttctcactcttcctcccaggtcacctgtgccttggctgctggggtgctgcctggggacctcctggaagtggtggtcttggttaaccccttctcagccaggcttctcactcagtccctggcagcgggtctcccttcccaagcaccccaggctctgagcagatgccaggtgcagtcggcctggggaagaagagtttgcagaatccaccgtcatcaggagccagagggcaggaacaggggttccctcccctgagactaggtatcccttgtgtatcccaaaccccataaaggggagcctctttgcaaagtcatgtgaaggccagaattctgggtctgtgtctcccttaggaaacgttgctcttccttttggtcccttggcatcaagaaaacaacagtgtagcgaatggtagccatgtcaccttttggttcagagagaggtttcggaatacaaaataataacagtgctggccgggcacggtggctcacacctgtaatcccagaactttggaaggctgaggcgggcaaatcgcttgaggtcaggagtttgagaccagcctggccaacatggtgaaaccccatttctactaaaaatacaaaaattagacaggtgtggtgacgcacgcctgtaaccccagctacttgggaggctgaggcagtaatatcacttgaacctgggaagtggaggttgcagtgagccaaattgcaccactgcactccagcctgggtgacagagtgagactctgtctcaactaataataataataataataataataacagcagcgatgagtatgtgtgccagagagtgtgcaaggtactttgaatgcatggtcttgttggaccctgacgagaaccctttgaagtcagtgctgtggttgttcccattttgcagatggggagactgaggtgtgggggcatcagacaacttgcccagctttgcacaggcagtaagtggtggacatgaaccaggtggtccagctccaggcctggaccctcaatccccaggccttgctgcctctgcctgggaaaggtccccaccccacttctgcccgggatgtgctccctaacctctcccaccgggatgcccaccatctctgggcattctgggttcagacagtggtgcttgtcttgcccctcagggatctgtgtctgcagccaccataccgagggcccatcctgtgaacgctgtttgccaggtttctatggcaaccctttcgcgggccaagccgacgactgccagccctgtccctgccctggccagtcggcctgtacgaccatcccagagagccgggaggtggtgtgtacccactgccccccgggccagagaggtaagtgactcctgccccggagccctgccccgcagagggccaagccccggcactgtgactatgccctgggctccagggttagggccctgggtttagggtgtggcaggtgagggagagcccagcttacgggcagcaggcatgacctctgaggacacggaatccctcagccccatagccagagccccaggctgccgcacattgccagcagaatttgggccattgagaatttgggctatttgaaaatacccgtatctggtccctggccccttagagcctgggttagtgatagctgaacaagttccctgggtgattctgttacacagctaaggtggaaaacctcgattaaacttctagcctttaaaaaatgtcatcaggtaggtaatgtgcaaagcagaaccacctacgcccacccttgttcccaggctccttgtattctttcctgctctggactcagacatcctcgactctgattttttttaaaaagcagctttattgagatactattcatatacctgacagttcacccatttaacgcatacaattcggctgggtgtggtggctcatgcctgtaatctcagcactttgggaagccaaggtgggcacatcacttccgtccaggagttcaagaccagcctgggcaacatagtgagactcccatctctaaaaaaaacacaaaaattagctgggtgtggtggcatgcacctgtggtcccagatactctggaggctgaggtgggaggatggtttgagcccgggaggcggaggctgcagtgtgccgagatttcaccactgcactccagcctgggtgacagagccagaccctatatccaaaaaaaatttttttttaaataaagtacaggccgggcatggtgactcatgcctgtaatcccagcactttgggaggctgaagcgggtggatcacaaggtcaggagtttgagaccatcctggctaacacggtgaaacccgtctctactaaaaatacgaaaaattagccaggcgtggtggcgggcgcctgtagtcccagttactcgggaggctgaggcaggagaatcgcatgaacccaggaggcggaggttgcagtgagccaagatcgcgccactgcactccagccggggcaacaagagtgaaactctgtctcaaaaaataaaataaagtataattcaatgacttttgacatgttacaatagtaatttttattatggtaaaatatatataacgtaaaatttgccattttaaccatttctaagtgcataactcagtgtcaggaagtacaatttgcaatgctgtgcagctgtcactcatccatctctagaactttatcatcatcccagacagaaaccgtacccatcaaatgtgttgttgaggccaggcgcagtggctcatgcctgtaatctcagcactttgcgaggctgaggcgggcggatcacctgcggtccggagtctgagactagcctggccaacgtggcaaaacctcgtctctactaaaaatacaaaaattagccaggagcggtggcaggcacctgtaatcccagctactcgggaggctgagataggagaattgcttgaacccaggaggcggagtttgcagtgagccaagagcgtgccactgcactccagcctgggtgacagagcaagactccatctcaaaaaaattaaaaaaaaaaaaaaaggattgttgaatagcccttcctccctccagcccctgataacagctgttctcctctctgtctctatgaatttgactgctcccagtattccatttaaacggaaccatacagtatttgttcttttggatctggcttgtttcatgcagtgtaatgtttttaagattcctagacatctgattttgcttttggtacgtgtggctgcattaaatcaatttgtcaaatgccatgtgctttcactgggactgttctgaaagcagctctctggcagccaacagccaacagggcagggcagatggctccagagccgggagctcaagaaccgagggatggagattgcactgcgggaccctgcaccccactggccgccatgctgtccctccattctcgttatctcccttacattttctagctcccgactgtggctcccctggcctgcagacatgcacgaggcccacccagtgagagtggacagttagagaagctcaggtggacccaggctgagacatacttgagggaggatttcaggggagcaggcagtgctgtgtgcagagggaaccacccttgggagggagggacacctggagtggactttagacctgggaccttctgccagtgcccttcttatccacaccagtgtcctctgggccccgggagggcctagcacactgagagctcacctggacatctgagtcagggttgaccggggtcaagtcctgatgctcacttgtcctgggaagactcctgcctgccatcctggccccttgcagcccctcccaggacttccagagctgcctcctgccctatgagctgtcctcacctggttccaggtgaatggccacttaaccatggggctcactcatcatcatcagtttcaatctccccctttcctgtctaattttatttctattttagaatccacaaggcaggtgctagcctcgaccttgaattctgttccagtttgtcttttcctttccgttccgttccgccttttccttttcagggttgcccttagcactattaacttttttttctctggaaacagagtctcactctgtcccccaggctggagtgcggtggcatgatctcagctcactgcaacctccacctcccaggttcaagcgattctcctgcctcagcctcccgagtagctaggattacaggcatgcaccaccatgcccggctaatgtttgtatttttagtagagatgggattttgccatgttgaccaggctggtttcaaactcctggcctcaagtgatccactcacctcagcctcccaaagtgctgtgattataggcatgaaccaccacgcccagccagtaccattaacttcatttcaacagaccgatgacttttgaggacacaaggagctcacaactattcttcacaatggcagcagctattttttaattataaaattagtacatactcttgactgacttagtaacttcataaaaaataaaaataaatgaaaatagaaataaatgtacatggccgggcacagtggctcacgcctgtaatcccagcactttgggaggctgaggcgggcagatcacaaggtcaggagatcgagaccatcctggctaacacggtgaaaccccatctctagtaaaaatacaaaaaattagccgggcgaggtggcgggcgcctgtagtcccagctacgcgggaggctgaggcaggagaatggcgtgaaccccggggggcggagcctgcagtgagccgagatcgcgccactgcactccagcctgggtgaaagagcgagactccgtctccaaaaaaaaaaaaaaaagaaatgtacatactcattgtaatgttggagcagtgtaaaaatgtcaagaggaacatgaaaaaaacatgtgagcagccgggcgtggtggcttacacctgtaatcccagcactttgggaggctgagccaaggcaggcggatcacctgaggtcaggagttccagaccagcatggccaacatgacaagaacccgtctctagtgaaaatacaaaaattagctgggtgtggtggtgcacgcctgtaatcccagatactcgcgaggctgaaacaggagaatcacttgaacccagtaggtggggcttgcggtgagccgagatggtgccattgcactccagcctgggcaacagaacaagactccatctaaaaaaaaaaaaaaaaaaaagaaaaggaaagaaaaaatcatgtaagcaaggcagcattcttgtcacctccaggggaccatggctattatttgggcctgacactggtttcatgtagatataggcagagagatgggcatgtttacaaagagtggctgacaccatgtgaagcacttggaacaagtatgttcttttatgctccgtctatgtccagagtagacctctagaaccaccctccaaaagccccctcgcacagcatgtcttctgcagctcacaggtaacctggaggctggaagatgagccagaaagcccaggtcaaacccagaaagcaggacaggagtctgcaatgcacagtctagaggaagttcagaaaacatgagaaacagaaaaggtaaaggggccagggattgcaaaggaaaatgcacccagctaagagggggatgaggaaaaggacgaggagaagcagatgaatgacattggatggtgacaatgaagagggtgaggaagaagagagtgatcaagacaatagtgatgaagaaaatgaagataatgatcaaaatgatgacaatgaggtgatgataaagataaggtgacgatgacagttgtgccagtgcagcgggaatgtggacctcaatgctgtaggcaactgtgacccgtgtctggccactgcctgcactggctacacaccaccacacgtgatcacgggtgatgatgaggataatggtcaagaaggtgatgttgatgaagataatggtcaagatgacaatggtgatgaaggtgatgatgatgagaataatggtcaagatgatgatgatggaggaaggtgatgatgagaaggatgaggttagtggtcaagatgatgatgaagatgatggtcaggatgatgatgaaggtcaggcacagtggcacatgcctgtaatcccagaactttgcgaggcctgaggtcaggagttcgagaccagcagggccaatgtggcgaaaccccatctctactaataatacaaataaattagccaggcatggtggcacacacctgtagtcccagctacttgggaggctgaggcaggagaatctcttgaaccccagaggcagaggttgcagtgagccgaaattgcgcccctgcactccagcctgggtgacaggacgagactgcatctcaaaaaaataaaaatagccggttgtggtggctcacgcctgtaattccagcactttgggaggccaaggcgggcagatcacttaagtccagaagtttgagactagctgggccaacatggtgaaaccccgtctctactaaaaatacaaaaattagccaagcatggtggcgggtgcctgtaatcccatctactagggaggctgaggcaggagaattgcttgaacccaggaggcagaggttgcagtgagccgagatcgtaccacactacactccagcctgggtgatagagtgagactccatctcaataataataataataataataatataaggatgatgatgaagaaggtcatggtgattgaggtgctgctggggatagtggtgatggtgaagataatggtgacgatgatgatgagggtgtgaggacagatatgtgatgatagccaccactcctgagtgcttactacatgtcaggctggatgttaagcgcttttcacaaattatgtcactgaatcctccccacagtcctgtggggagctgccattgttgtccccgctttagagatgaggaacctgagctcctagaggcgcagtggcttgctcaggaccacacagctgtgggcagccactgggggccggtcccaggtcctcctgcccaagcccgtgctgctccggggaaggtggagggacgcttgctctgcttcacacccaccctcatccctggtgggtccagccagctgtgttccccacacgtgctccctctacacacagggcggcgctgtgaggtctgtgatgatggcttttttggggacccgctggggctctttgggcacccccagccctgccaccagtgccagtgtagcgggaacgtggaccccaatgccgtgggcaactgtgaccccctgtctggccactgcctgcgctgcctgcacaacaccacgggtgaccactgtgagcactgtcaggaaggcttctacgggagcgccctggcccctcgacccgcagacaaatgcatgcgtgagtacctacctccagaccccagggtggcacatggtgggccccttctcttctgccctggctcagggcccagaaggggtggctgaggaacccaccagaaccagctggctcctctgcaaggctgtccagcctcaggcaggtcacttcccttcctgtctccatgtccagaaagcacaagggtttgcccctctcccaggtctctttcagccgggagatcttataaactctgatccgaagcctggattgtctagtgcttacctcccactctgcagtcagcacgtatggctgacccggtgatcgccctgcgccgggtctccatggccatgcctcccctcatcacctcagttaacactcagcccctgggaggctcccagagccctgcaggagggaagctcagcctttgctccacactgatgtgcttggagccctttcccacgcagcagctgccggctcctgctcactctcgctttgtggaacccctgcaggaaacaccgctctggcccagagtgagatgctcccctggcagtggccaggagaacagggtcacgggacccagagccatgggtgcagggctgtgcctgtgaccctcgcccaagtctctggccctctgcagcctgccagggctcagggcaggctcagaaggattgtctgttaccatgaccgtcctgggctgtccctctaaggatatagtcaatgggctgaggcttgagcttggccctggagcctttttccagcagtggcgtctgaatctgggctgaatgtgccgtatcatctctggaggctcccccatctcctctgcctctgttggacccccaaagttggaacagacaatctgcattgttcccaacaccccttcctgctcctgcccccagcttgcagctgtcacccacagggctcggtcagtgagcagatgccctgcgacccagtgacaggccaatgctcctgcctgcctcatgtgactgcacgggactgcagccgctgctaccctggcttcttcgacctccagcctgggaggggctgccggaggtaggtagggtgagactgccggtgccctggggacctctccaggagggaagaaggcatcgggcagcccccagggaggggcctggtttggaaggtgttgtcctaggcccactgccaggcacattgtgccctttgccgaaggggagcaaagggatggactcttggcatccgactcatgctcctgccagcccaggatgcaggccaagagcagccctaaagggtgtccaggcaggcaggtggccggtttggtctctgattcccttctcagtgacactctccctgggtggccttttggccacagtagcaccttagacaagtgttcttagggaacaggaggactccagggaaacaccaagtggagcaaacaggtttcttccttgcaggacttctcagagctcttactatgctgattgcatcatgactttccaacagaggggtatagtctccccgagacacgtttgtccccatagccttattttatcttcttttctccctgagcatcctgggaaacttgtgctttccagagcacagctggggaagctgtgccatgcaccgagaggagatggggtcttgtcagcagagggctgtgatctgaggccccagccagctgcagccggcagaggctgggccaggagtggccctgagcttgcctcagacccagttccttccctgatcacagctgcaagtgtcacccactgggctcccaggaggaccagtgccatcccaagactggacagtgcacctgccgcccaggtgtcacaggccaggcctgtgacaggtgccagctgggtttcttcggcttctccatcaagggctgccggggtaaggaggctgggtccttcccgggctgccctgagggtggggcccgagggtctctgggcagagatgactgatggggaaaatgggcgcagcaggaaaggatcgtcagacatgggacagggtcccgagagcagccggaagcatggagcgagttgctcccgtggcagtggccgggacagcagagtcacatgacccagagcagtgggtgcagggctgtgcttgtgaccctcgcccaagtctctggccctctgcagcctgccagtgtcctcatgccggccaggaatgtagtcccagacgcgctgttaagtgcctgtgtgcctggggccatcatgtcactctctgggcctcagtttcctcacctgtagagttgggctgcattggcagttcctaaacctggctggtcctcagatcccgagggaacattggaataagccaggctctgtgccaccttcaaccttctgaatcagaatctccagggaagggcccaggaatgtttttgatgctgcctagggcattctgggaacacccagaacccagcacgcactgcccctggcccctctaaacccagcacgcactgcccctggcccctctaaacccagcacgcactgcccctggcccctctagcctgcaggtgctccccactgggcgctgcctcggcccagtgccacgagaacggcacatgcgtgtgcaggcctggcttcgagggctacaaatgtgaccgctgccacgacaacttcttcctcacggcagacggcacacactgccagcaatgtccgtcctgctacgccctggtgaaggaggaggtgagtcggcccagacccactcacctttccattcattctgtattcccagcaagtgccagctctatgccgggcaccaggaactgcctgcttacccccagtgctcaggctttgcaagcccaccacctaccttctccctgtgcccacccagcttcaggcctgttccagcctggctcgaccctcacctcggcccttcccctgctctaggtggatgggggaaatgtgactcttgtcacctgcctttccccaccacgccaggctggggtctcactctctcaggttcggtggggatgagaccacagatgaccccttggtaaagagggttaacaggaggtgattctgagtgggaaggtggctggtgcagaagtccggagttcaagctctagggttaacccattggggttcccctcccccaactccattcattgtcatgtgtctgggcaggcaacagccttggtaagcctctgtctctttcgtactccagactggagatagttcaggcctgcaatccttttctagaaaccagtggggccagctttcagaatgtgtggcattgtagaaagataagatggcatacactgaaggccgggtgctgtggctcacgcctgtaatcccagcactttgggaggctgaggcgggcagatcgtgaggtcaggagtttgagaccagcctggacaacatggtgaaaccctgtctctactaaaaatacaaaaattcgccgggtggggtggcgcgcacctgtaatcccagctactcgggaggctgaggcaggagaattgcttgaacccaggaggcggaggtcgcagggagccaagatcatgactgcactgcactccagcctgggtgacagagcaagactctgtctaaaaaaaaaaagatgcatgctgtgctgaatatcacataatcccccactgtgaatgggcagcccccatagtcaagcccagtgatatttatgcaggaaaacagacgactatttccacgaagtgggtaaatgaagaccacaagtagcctttttcagaacaggtttatttcaggtaaggttttgctctcgagtgaggaatggaatgccttgtggcttttcagaacattttggacttgggaatggaggacagggcccaggacctgtgcctgccacttcacttagagcggtgacaggaggaatcaagctgggacatggcaggcatttgtgctgagactggctcctaggaagtgttctgtaaatgcagttattgtttgtctgatgaaaagatggagctagggtatgttcatagcacattcagccagtgtccatagtgtgctttctccatgtggcgtcctgggaacacagcgaacaggacaggcagaaatcctcgtggggcatccctccccatcccttcctccccaccttccgaggtaggacagcagtgtggtcagcggtgtcggcaggtgccgtgaggatgggaggggaagggacagctaccatggggtgggcaggattggctctcagaggtgtggcatacccttagcgctgaggcccaggggaggatttggagaagggaacccccagggagagtggcagggtagaagccagcgggagtgtctgggcaggacctccatgccaccagcctcatacaccttttcttcctgtcctctccaggcagccaagctgaaggccagactgactttgacggaggggtggctccaagggtccgactgtggcagtccctggggaccactagacattctgctgggagaggccccaaggggggacgtctaccagggccatcacctgcttccaggtacagcaggagcgcagagcgggagggtgggaggcaaggggaggcccccagcgcctgcagtctggtgtcgttggatgctttgggggccctcccaaaacagccctgttgccatgggcctttacttccctagcccacctgtaactttattaatatcagtccttgtcaccatgcctctgccctactcagactctaagctcagtgaggatggggctgggctcattcatttattcactccctccacaggggtgtcatgaggcgctgcttcagaggctggactgggagggtcttgctgtcttgattcttggccgttttgctctgccataggccagcacggtgctcagcacatagaaaatcttaataaatgagtaaataagacaaaagaaggagggccaggtgtggtggctcgttcctgtaatcccagcactttgggagccaagacaggaggattgcctgagcccaggagtttgagatcagtccgggcaacacagcaagaccttgtttctatgaatggaagcagggagggagggaggacctggaaatggcgctgaaatggattggattactttgtgaagttttatatgtgtaagtgctacactcctttagcagccagacagaggcgagctgagaacctgttagcaggactcactgtggaaataggggctatcagataccgtgtcttaaaatgcccacatgtgagccacattgtgaatcagagctgatttgaagggtccagaattgcttgtgtggctccagaaggcctgggtctctcccggtccctgtgtatgactgacttgctgtgggtaggacctcgggtcatgtttgccttctctgggcctcggcctgcacctggaaaatgggggtactctgcctttgggactacctgttggtgctcagggctgctgatgcctggggaatggaggccacagaaggggacccctgggggtgggggcttttgtgtgacatctccaccactttgtgacccctgggctgtgggcttcccataggggctcgggaagccttcctggagcagatgatgagcctcgagggtgctgtcaaggccgcccgggagcagctgcagaggctgaacaagggtgcccgctgtgcccaggccggatcccagaagacctgcacccagctggcagacctggaggcagtgctggagtcctcggaagaggagattctgcatgcagctgccattctcgcgtctctggtatcccaggggacccccctacccgaacacaccaaacctgggcattggtccctgccccagccctcccattgacctggtgaccttgggtatgactccccactttgggaggcttaatttcatctgcaaagtggggatcacacagtgcctcctcctggattcagcgagaggatgtttgcaaagggcgaggcatgttccgaggagactgaatgcgcagtaagtggtgggctgcatccttattggtgtttctgcatcctaggactccgctcactgaatgccgatgttgtggccagctttgtgcatttataaaacgacgggtgccatccagttctgcctcacaattggaccagatgtggcccttaccctttggcgatgggccatcagtttcctcctcttcctcttctttctacaggagattcctcaggaaggtcccagtcagccgaccaaatggagccacctggccacagaggcccgtgccctcgccaggaggtgagtcccaagacatggtgagcttacacctggcccttctcctgggggttccagggtcagagtcagccccacaggtgcccccacccagaagttgggatcagatattacaagagctgtctgatggaggcagtgtcaccagcatggggaggggcaggcaaggtgggtataagtccagagatgttaggggcaaagcttggtggactgaaggcgtcagagagcatctgccggctttctctttgtgagagttgtgtaatatacaagttattatattgggggtatagttcacactatacagaggcctttgcccactgcactccagcctgggcaatagagtgagactctgtctcactgtataattcagtggtttccctatattctcagggttgcaaagccatcaccacaaccagttttaggattttcatcatcccaaaaacaaacccctggacccatctgccatcagcccccgtttctccttacctccccagcccctggaaccactattctactttctgtctctatagatatgcctattctgggtgtttcatagaagtggaatcagacaatgtgttgccttttacaactggctgctttgcacagtgttttcttttttttcttttcttttcttttttttttttttttttttgagacggagtctcgctctgtcccccaggctggagtgcagtggcgctatctcggctcactgcaagctccgcctcccgggttcgtgccattctcctgcctcagcctcccaagtagctaggactacaggcgcctgccaacatgcccagctaatttttttgtatttttagtagagatgggggtttcactgtgttagccaggatgatctcgatctcctgaccccgtgatccacctgtctcggcctcccaaagtgctgggattacaggcgtgagccaccgcgcccggccagcacagtgttttcaaggctcatccacattgtggcatgggtgagtgcttcactcctcttacagttgaataatatcccattgtatggaaatgccacatgttgtttatccgtcttctgttaacagacacttgggttgtttcatccactgcctttaaggagcagcttaaggctgggtgcggtggctcacgcctgtaatcccagcactttgggaggctgagacaggtggatcactagaggtcaggagttcaataccagcctggccaacatggtaaaaccccgtctccactgaaagtacataaattagccaggcatggtggcacacacctataattccagctatttgggaggctgaggcaggagaatcgcttgaacctgggaggtggaggttgcagtgagctgagattacaccactgcactccagcctgggcaatagaatgagactccatctcaaagaaaaaaaaaaaaaaaaagacgcagcttaagatcctaaaaacacaggatctgtgacaattttctcctttagctacgctccagggaccttagacttattttacagatgagaaaacattcagagaagttaaggaatttcctaaggacacacagcttggaagcaataaagccaggattcaaacccaggctgtcgtgaccactctcttctatgctgtctatattggggtgactgtacaatttattgtccaaactgagatgctttcacgtgtgataaaaggtcctattggccaggcacagtggctcacacctgtattcccagcactttgggaggctgaggcatgaggatcgtttgaggcaaggagttacagaccagcttgggcaagatggtgaaacccccatcgctacaaaaataattttaaaaattagccgggcatggtggcacacacctgtagtcctagctacttggaaggctgaggcgagaggatcccttgagcctaggagtttgaggttgcagtgagctgtgatggcaccactgcactccaacctggacaacggtgtaagactccatctcttaaaaagaaaaaaataaggccctggctgggtgcagtggctcacgcctgtaatcccagcactttgggaggccgaggtgggtggatcgcctgaggacaggaggtcgagaccagcctggccaatgtggtgagaccctgtctctactaaaatacaaaaattaactggtgcacacttgtaatcccagctactcgggaggctgaggtaggagaatcacttgagcccaggaggggaggttgcagtgagctgagatcacaccactgcactctagcctgggcaatagagtgagactctgtctcaaaaaaaaaaaaaaaaagtcctattaatccttatgtcaggacaacagacacaaactctatgtctctgtgtaacagaaacagggcatggagtacctttcctgtcagtccttgaagtgcgtaacacagaaaggtggaaaaggcgtacctgtctttgtggctgtcctctgttaggggcagcaggaggcctgtgtagtagggggcgtagttctgatcctgggccccttccctgcgagcccttggtaatgctcaggtgggtgtcctcacacagccacagagacaccgccaccaagatcgcagccactgcttggagggccctgctcgcctccaacaccagctacgcgcttctctggaatctgctggagggaagggtggccctagagacccagcgggacctggaggacaggtgaggcctccccaggtgtgggtagaaactttggggttggcctcctggagccaacagggcctagccaaaggctgctggttccagagccagctcccttgagtcctgacgttctttgtcgttggtgtcttgggtctgcatcctcctcggagtggggccacagggtcttgggcccactcggtggtgagtcgcagtaacccacttttgcctggggggatgcaactcagcctcttcaagagaagagacaagaactggaacccagagcaacagatcccttgctctccttctgccgcattccctgacccccctggccccggcgccccagcccagggcagctcctctgagctcctctgaggcaccagcttctttctctgcctctgcagacagacggctctgcttttctgctttggtgaccccttctgtccctctcagtttaaaggttcatggagactccccagcatcttgcttgagccccttgacattcctaaacgagacattcctaaacgagaatgggattggctccgcttagatcaggtgtccagccctgagccagtcaccatggctgggggaggtcacatgacccaccccaggggcagagcgatggctctctaaggaggagtaagggatggaagggaagccagaggtctccaccccagcaatgcccttgtcgaggaagaatgggtgggacaggatgtggacagctggtcaggacagaaaacccatcctagctgattggttatagaccacaggcctgtcagggcaaaagggcccacagggattctgcagcccagggctctccattcatcagtggtgaggacgtgcccaaggtctctggaaagggcatggccgagccaggaccaggaccggggccgctgtgctccccacttcaccgggcattttcctcttcaccattcacccagaagagccaaacatttgcaaacatgtgattcttgagtggaaaccaagcagagccctttcagcaaagtgtggctgagctgaatgatgcagaaacaagaatgtggccctttcacagcccgtctggctcatctgaaagcttcagagaagcagccactttccgaggcagctgtacctaccccgcagagggctattctgcctgggaagttggcagaggcctttgcaaaccagtggctccagcctggggcccagacagggatggggagggctagttctgcacccagctccgtggcctctgcttcctcccaggtaccaggaggtccaggcggcccagaaagcactgaggacggctgtggcagaggtgctgcctgaagcggaaagcgtgttggccaccgtgcagcaagttggcgcagatacagccccgtacctggccttgctggcttccccgggagctctggtcagctcagttgtctcagagctccgtgtggggtcgggaggatctattatagaagctggaggctgggcacggtggctcacgcctgtaatcgcagcactttgggaggccgaggcgggtggatcacctgaggtcaggagtttgagaccacctgggccaacgtagtgaaacctagtctctactaaaaatacaaaaattagccaggtgtggtggtgcgtgcctgtaaccccagctactggagaggctaaggcagaagaatcacttgaacctgggaggcagaggctgcagtgagccaagattgcacctctgcactccagcctgggcgacagagcaagactccatctcaaaaaaaaaaaaaaaaaaaaaaaaaaaaaaaaaaaaactattatagcagctggagaaaccggtggggcccaggcagaggcaggtgatatggctcatttttaactatattgcagctaagtcaaatgatataacctacctatggggcttggcagagtcagagctcaaccatttcaaccattctctgttgataatgttaaggctggggcctcttcctccttacagtgacattagcagtgtcatcagatggacacgggatgcaatcccagctctgccactccagctctgtgacctcggccaaggactttcccttcctgagcctcagtctgtcacatagaactcacccattaggttatttcgaggctgcttccatgggagctggacagagattcgggagcaatgcacgaggtagctggccgacccctctgtgctcatcgccttatactcatcacctctgcatgaaccgggtccatcgtgtcgattcagtaaccctgaaatcccaaaactcagaaactgaacattaaagaactcagcttggccgggcgcggtggctcacacctgtaatcctagcactttgggaggctgaggcgggcggatcacgagatcaggagatcgagaccatcctggctaacatggtgaaaccccatctctactaaaaatacaaaaaaattagccaggcatggtggcgggcgtctgtagtcccaactactcgggaggctgagaatggcatgaacctgggaggcggagcttgcagtaagctgagattgcgccactgcactccagcctaggtgacagagtgagattctgtctcaaaacaaaacaaaacaaaacaaaaaaaactcagcttataaaaatgcatttgggacaagtgctaacccagattgatgcccaaggctgcttatttgagatctttgctcctcccactgcgtgcggagagtaatgcacagctgttagtgtgtttgagcccaggttctgcttccagcaccactcagggtgttaggtcataggtagaacctgcacagttctcctataagtctgggaaattctgcattcggaagccatccagcccccagatctcagttcagggctgtggagctggggaagcattcccactttgcagtggggcagtgtgggtcagggaggttagctgggttgctcaaggccacgcagctagaaattggtaggactgtcatctgagccccaagtaagggcttccccagcctggctcctctcgccctgggccctctgcctccaggggtccacacaaagcctgacccctgctattcctgcctctgggcttccgagctacctggggcatcagctaggctcaccaggttttcagggggcttgggttcttggctggcagccaggggcagacccgccgcctcagcccagcagggcacctcccccaaggagaggatccgctgcttgcccttcctttccaggccctgcctgagcgcattgtctccctgcagcctcagaagtcccgggctgaagacctgggcctgaaggcgaaggccctggagaagacagttgcatcatggcagcacatggccactgaggctgcccgaaccctccagactgctgcccaggcgacgctacggcaaacagaacccctcacaaaggtcagctcttgtgctttgaagcaggggacctgggagaggttggggctaccctgaaggtgatccagggtcagggttgcaggagggagaagggcagagacagaagtagctctgtccggccgggtgtagtggctcacacctgtaatcccaccactttgggaggccgagacgggtggatcacgaggtcaggagattgagaccatcctggctaacatggtgaaaccccatctctactaaaaatacaaaaaattagccaggcatggtggcatgtgcctatagtcccatctacttgggaggctgaggcaggagaatcgcttgaacccaggaggtggaggttgcagtgagctgagatcgcgccactgcactccagtctggcaacagagtgagaccccatctcaaaaaaaagaaaaaagaagaagtagctctgtccatccctctggtgcctcctgcaaaactccacatacagcctgagataggggaggggaccctgataccccgagaagagatgatggatagactgacagaggacagcagcagcagcacccggggccacacccaccatcctgggatcattctctctcatgcctccattcattagttcattctctagttcattcatggctcatttgaaagctgcagagaagcggccactttccaaggcagctgtaccgataattttgtttttaattttgtttttgaaacagtcttgctctattgcctgggctagagtgcagtgacacaatctcggttcactgcaacctccatttcccgggttcaagtgattctcctgggtcagcctccagagtaactgggactacaggtgtgtgccaccgtgtctagctaaattcttttgtatttttagtagagatggggtttcactgtgttggccaggctggtctcgaactcctggccttaagtgatccacctgcctcggcctctcaacatgctaggattataggtgtaagccaccacacccagcctcattcctttttttttttttttttttttttttgagacagactcttactctgtcaccaaggctggagtgcgtggcgcgatctcggctcactgcaacctctgcctcccaggttcatgcgattctcctgcctcagcctccagagtagttgagattacaggccctcaccaccacgcccagctaatgtttgtatttttagtagagatggggtttcaccatgttggccaggctgaactcctgatctcagatgatccacccacctcagcctcccaaagtgctgggattacaggcacgagccatcacacccggcttccattccttttaaagacaggataagggggctgtctgtgaggcatgagaatgtatctgaagagctgagcccagtgcctgccgcttacccggggagtttggctttgcccccggggtagcacctgctgatctggtccactgccctcgtccagggtgaggttgccaggaagagaggtgacttccccaggagtcagggccaggccccagcgtgtacagatgcctcaccccaccacagcacccatgccttcgtcctcctccccaccccatgagcaatcagaataggcctgaggcagtactagtggctcctcaaactactatttatttattcttgttacagtgacattcacgtggcatacaaacacccattttagatgcaatggctttagcacgttcacgatgttatgccacctccacctcagtctagtttcagaacattctcaccacccctaactccatgcccactcagcagtccctcctcatttccacttccgaggcccgggcagcctccactctgttctctgtctctgtagatttccttagtccagctcttttgcagaaatggaatcgtgtaatatgtgccgatggtgtcaggcttcctcctgatggcatcaccttttcagggttcacctgccttgcggcctggatctatacttcctccctttgaaaggctcggtcatattccagtgtgtggatgaagcacattttgtttacccactcatctatcagacccaaattctttcagtgtatctagtcctgttgagtggcagtggggaagaaactgatcttccataagtcaaggtggtgtcataaacagatttgcgattttcacatccacttgctgagatagagcagtgttccctccctccctccctccctccctcccttccttcctttctttctctctcttttttagatggaatctttatgccacccaggctggagtgcagtggcttgatctccgctcactataacctctgccccataggttcaagccatactcccgcctcagcctcccccagtagctgggattgcaggcatgcaccaccacacctagctaattttaaataaatttttagtagagacagggtttcaccatgttggccaggctggtctcgaactcctgacctcaagtgatctgcccacctcggccttccaaagtgttgggattacaggtgtgagtctctgtgcctggccaatagaacatgttctaaagagatgttcaggtgttctcgttcctttaattctagtgttttagttttcctccgggcttttgtggacaggtatctcttgggagacattcggagttcaacttttgtataataacacagatcaggtgctcctggtggacagcgtgacccagcgtcagggatttggtgatgatttgggcacccatgtatgtgggtttggtgcccactgagctgcccctgggccctgctcctgtggagccagctgcccagcctctcctcatctctctccagctgcaccaggaggccagagccgccctgacccaggcttcctcatctgtccaggctgcgacagtgactgtcatgggagccaggactctgctggctgatctggaaggtacgtgagtccagctgaccactaggctgtgtaatgacgaacgcccctgacagccactcacctctcgcctcagccagggcaggcttgcagaggacaggagtctggtcttgtgggcttaattaagccaaacagactttccctccacctctcaggatcctgccccatctcatacatcactcacctcggacttgcccatgtggctatcccatacaccccaggtcatcagaccacatgcagagcccctccagaccaagtgagaggagactctaacatcattggctgttcaaccaggtcaagtccactctggcctgggctccagttagttatctgatacaaatatggctgtccgggtccaatgttgagttggggctatgggaagcagatggagtttctctttagaaggggctatgggttgatgccagtctagtgcccccattttgcagatgggtaggctgaggaaaggaattgctattcatccctgggtcagagctaagctgggaatagaagccagcaagtattacgattctgcaagtatccacctgtgtgatgggcttctgtgatacccaatttgctccagagagaagccccctcaccctttgtttgtggctccttatccaacgggctggataaggcaggaacacactctgaaccccagatgtctcttggggtctgaggccagaagtcaggcttctgctgttgttctgtggcctccctccccagccctgcccactgcccggaagagatggagcgctagctgtggacccagcccctctggggcagaggatgggctggtcagtgctcctgttccccagcttcctggcggcttgaagtcctagtcacccatcgtttggggacttcctgtcggaaaggcgtggccgtgtgtgcttaagtatctagagtcatatttagaaaaaggtacattcaatgacttataatgatggaatgttaggatcttagaacattagaattataagaggtcttaaggtcatctgctgcaaatctcacacctggcagtggactcgcccaccctcagcttgcctatctccaacaatggggggctcactaccttacaagcttttaccttctcattgtcgggttctgagaatgagaacattcttgtgtgtagtggatggaaatttccttgcactgttcccataatccacaggagggctaacctcaaacctctaaccccaggctcttttccccattctgatcccattttagagacaccctttcttaccaccagcttggctgtgctcagttggtgttcaggataaaaggaaaattcacaaggtgaactgtggagcagtcttccccagggtgtggccgggggtctcctagcctattgatacgctctgccaagagagggtttgtgttcaaataagtttaggaactgtctcttgctgcagcatcctcttgaggtcttacagagaacgcttgagaatattaaaggttctgagaaggcctgtaataaagaaacctgcttcactttcaacttaattgacacttccccctaacgtttgttaacaccgtggagaattagggctccacacaatacatgctgagaaacatcaattttgtgtacaaggagcaaagcaggtctaatttctggatggaacaattctataatattatgccctcaaagattagaaggctttattcattttaaaaattgacttttactttgtccactgtaataagtgctttttttttttttttttttttttttttgagatagagtctcgctctgttgcctaggctggagtacagtggcatgatctcggctcactgcaacctctgccttctgggttcaagtgattctcctgcctcagcctcctgagtagctgggattacaggtgcccgccaccacacccggcatttttttttttttttgtatttttagtagagacagggtttcaccaggttggacaggctggttttgaactcctgacctctggtgatctacctgcctccgcctcccaaagtgttaggattacaggcgtaagtcaccgtgcctggcctgtattcagttcttttgatgataaacttcctttagaatttttttttgagttggggtctcactctgtcacccaggctggagtgcagtggtgcaatcatagctcactgtagcctccaactcctggcctcaagtgatccttccacctcagtctcgtgagtagctaggtctataggtgtgtgccaccatgcccagctaagcttttgtctttttgtagagatgaggtctcactatgtttcctaggctggttttgaactcctggcctgatcctcctgcttcagcctccagagtagctgggattacaggaatgagccaccgcacctgactaaatttcccttagaattttatctgaaaggaaaggaaatagtctctttgtttaccaagaaataaactacttcttattggataataaaatctatgggaattctaacatttcctctgggtgtggtggctcacacccgtaatcccagcactttgggaagccaaggtgggtggatcacttaaagccaggaatttgagatcagcctggccaacatggtgaaactccatctctactaaaaaaaaaaaaataccagccgtgtatggtggtgtgtgcttataatctcagctactcaggaggctgaggcaggaaaattgcttaaacccgtgaggcagaggttgcagtgagctgagatctctccactgcactccagcctgggtgacagagcgagaccttgtctcactgcactccagcctgggtgacagagcgagaccttgtctcaaaaaaaaaaaaaaaaaagagaattgtaacatttccctttttgtcttgattgcttgaaagctcagtggtcaatcaaacatttggtttctgcaatgtcattatcgagattttctggtacttctccctctcctctgtccttcctcatccctccagttacatcagactcttggttttccatggtaaggatccatttgttgatttacccatcactatacactgccttaaagcattgtttagacgtaggcagtacatgaaaatgccgagctgagcagactgagccatggactgtgctagtccccaccactggccccagcattgaccaccatgtaattccttgactttaatagacatcctaatagaatgaatactcatctcaaaattccccaagcagtatgtctgtgtctcgcttgcttttgttttctcctggataagcctgagaaggcgatatgcacgttgcatgcacttcagacctccactcgttgtccaagggtctgtggtcagccaggcagctctgccagcggctgcctgggaggcaccggaggtgtgagcccagttcccctgacccagcctcagccgggtttgcaggaatgaagctgcagtttccccggcccaaggaccaggcggcattgcagaggaaggcagactccgtcagtgacagactccttgcagacacgagaaagaagaccaagcaggcggagaggatgctgggaaacgcggcccctctttcctccagtgccaagaagaagggcagagaagcagaggtgttggccaaggacagtgccaaggtcagggtggtggctgtgacaacagtggcctccttccctcccggggggaccgcccttccgcgggccccttcccgacatccgtgctgactactccgcactcactcactgctcagtgggcccaggcaattagctcagagacttcacgggggtgagtctgtgggttcctcacgaaataggtgtcattgctgtccccattgtacaggtgagaatgctgaggtgcagccagcttcatgaacttaaccaggacttacacctgggtctgctggctttcctgcctaaacttctaggtttttcttttcttttttgttattttgaagtttgcgtttatttattttacctgcctttttgttttcaatttttttcttaattttttcagacagattcttactctgtggcccaggctggagtgcagtggcgcaatctcagctcactgcaatctccgcctcctgggttcaagtgactctcctgcctcagattccagagtggctgggattataggcgtgctccaccacacctggctaatttttgtatttttagtagagcggggtttcaccatgttggccaggctggtctcgaacttctgatctcagatgatccacctaccttggcctcccaaagtgctgggattacaggtgtgagccactgcacccagcttaagggtttttggttttgttttttttttttgcttgtttgtttgttttttgtagagacagggtctctgtcgcccaggctggagtacagtagcacaatcacagctcactgcagcctcaaacccttgggcttaagtgatcttcctgcctcagcctcctgagtaactgggactacaggtgtgtgccactgtgcctggctaacttttttttttttgcagagatgaggagtctcggccaggtgtggtggctaactcctgtaatcccagcactttgggaggccaaggcaggcagatcacttgaggtcaggagttcgagaccagtctggtcaacatggtgaaaccctgtctctactaaaaatacaaaaaaattagccgggcatggtggctcgcacctgtagtcctaactactccagaggctgagacacaagaattgcttgaacctgggaggtggaggttgcagtcagccaaactgcaccactgcactccagcctgggcaacagagggagactctgcctcgaaaaaaaaaaagaaaaaaaagattggggtctcactatgttgcccaggctggtcttgaacctctggtctcaagcaagcctcctgcctcagcctcccaaagtgctgggaccataggcatgagccactgcacccagccctggctgattttaactaggcttttaaaaaattggtgccaaattctaatcagtgcctatctccccagctctgctgctggttctgttgctcacacaccaaggaaactgtctttatggtgcctaggaaaagtgctgggtttgcagtaggggtccccgggcttgatctcttgtcatgcccctcgggctttggccagcccctcctcccctctgtgcctctgtttcctcacctgtaaaatagttagaattgctcctcctgaaacgggtggtatccagcagtctacactgtgcccagcacttagcctgcattcagtacatatttgttgcgtgcatgaatgaatgaatgatctgcctggtacagacaactgcttggcatcattgccataagagctatttacctccaaaaggacttgctgcactcacttcttctccctgccactgccacccatcccatagcttgccaaggccttgctgagggagcggaaacaggcgcaccgccgtgccagcaggctcaccagccagacgcaagccacgctccaacaggcgtcccagcaggtgctggcgtctgaagcacgcagacaggagctggaggaagctgagcgggtacgtttgccagggcccctaccctatcgcctcctgcccctggcagcccgggtggggacgccattcaagctgtttcttcctcctccccctgaaaggtgggtgctgggctgagcgagatggagcagcagatccgggaatcgcgtatctcactggagaaggacatcgagaccttgtcagagctgcttgccaggctgggtaaggaggccctaaggctgggccctgaacccctgggtccctggggcacctctaggatcttcctgtgagctccagtcctggggaagatttcctccttgtcctcattgccatgcttcccgcatccccatctttgtggtcaatcacaagcatttataaccatgcccaggcccccttgccatgtgggacagggttggcatctagaagtgagttcactttgagtaactgtttgtgcctccagggccctctattctttggggcagggcagggggcacacagaaaactcaccattggcaagaacacccacaggcaccgggtgagcaggtgagcaggtcagtcctcaggagctgagggttcaggagaagaagaaagactgtcacggcagaaagtgtcatcaggtgctggtctgggatcagactaagattcaagtctggctctgtcccttctttggccattagacctcgggcaagccactccacctctctgagcctcagatcccccatctggaaaatgggagtaacagtggggtggtttagaaagcgcttaccacggtgcgtggtgtatgttgagagtgagtaaatagcggctcgtaggaaggaggtcagattcaagatgggccttagcaaggaggcattttggatgaagggaatagcacctcccaaggcacgaaggttgcagaggcccagtgttgtggggaggctcaggagacagcagacagggcagttgggctgaaaagaacagcatgtatttttttcaaattgtaaaagacacataatattttccatcttaaccattttgaagtgtacagttcagcagcattaagtatattcattgttgtgcgatcatcaccactacccatctctagaacactttcatcatctccaactgaagctctgtcctcctgaaacactaaccccccatttccctcccccagcccctggcagccatcattctactttctgtctctatgaatttgactactctgggccaggcagggtggctcatgcctgtaatcccagcactttgagaggctaaggtgggtggatcatttgaggtcaggagtttgagaccagcctgaccaacatggtgaaaccctgtcccttctaaagatataaaaaaaattagccaggcatggtggcacatgcctgtaatctcagctacacaggaggctgaggcaggagaatcgcttgaacctgggaggcggaggttgcagtgagccaggatcacaccactgcactccagcctgggtgagagtgagactccgtctcaaaagaagaacttgcttagaatcataggtgggaattgaacaatgagaacactcagacacagggtggggaacatcacacactggggcctgtcatcgggtggggggaggggggagggatagcattaggagaaatacctaatgtaaatgaccagttaatgggtgcagcataccaacatggcacatgtatacatatgtaacaaacctgcacgttgtgcacatgtaccctataacttaaaaaaaaaaaagaatttgactactctggggacctcatataactggaatcatatagtatttgtacttttaaaatttttttggagacaggatcttgctctgttacccaggctggagtgcagtggtgcagtcgtggctcactgcagcctcaaactcctgggctcaagcgattcttccacttcagccttcgaagtagctgggaccacaggcacgcaccaccacacccagctaattttttttttttttttttttggagacaaaaaaatatgttccctatgttgcccaggctggtctcaaactactgggctcaagtgatcctcctgccttggcctcccaaagtgctgggatcacaagcgtgagccaccatgcccggccttatttgtcctcttttgactgacttatttcacttagcagaaagtcatcaagattcacccatgtggcagcaagcattttcaattttcattcgtagtaagaggagagagaattgccatgctctacacgttgtctggacaccaggcccacactaagctattcacacacgtgatcttacagaattctcatactcactctttgacgcaaggacagttattcttttgccgttttgcagatgaggaaactgaggtgaggagagtttatttttattttttatttatttttgtttttttgtagagacagcgtctcgttatgttaaccaagctggtgttgaactcctggcctcaagggatgctcccacctcaggttcccaaaatgctgggattacgggagacagccaccacacccagcttagcacagagtttagataatgtgcccagggtcccacagccagtcggtaggaaagccgtggctcacctgcgggtccaagtgactcagcgtgcgtgcaggtagccactagtcgacacctaaggccctgtcgtggagcagacactctcttcaaccattcctgcattgtcactgtcattcattcacttgtcacactctgtgttggccttgtgcttggcctggggatgcagaatgaagagcacacgcctggccccttctccaggagccctaggcagcctgggcaggtagagtgggggctgtaatccatttctgaatctcttcgaagaccaggctgtttggattttgctgtgggccatggggcctcttgaggtcctcctaggtcagcagggccttggctcccctctgccttctcttgcacactggctcagtgcttgcagctgcttgcccaggaaatccagggcctcggggatcccaggggcccagtggaatcctgtggggttagaagcagccacttggggctgggcatggtggctcatgcctgcaatcccagcactttgggaggccaaggcgggtggatcactggaggtcaggagtttgagaccagcctgaccaacatggtgaaaccctgtctctacaaaaaatacaaaaattaggcaaggcgtggtggctcacacctgtaatcccagcactttgggaggctgaggcgggcagatcacctgaggtcaggagtttgagaccagcctggccaacgtggtgaaaccctgtctctactaaaaatacaaaaaaattagcggagcatggtggcaggcacctgtaatcccagatactcgggaggctgaggcaggagaatcgcttgaacctgaggccacagtaagctgagatcgtaccactgcactccagcctggacaacagagcgagactccgtctcaataaataaataaatgcatccatccatccatacatacatacaaaaattagctgggcatggtggtgtgggcctgtggtttaccccagtgattgcccacatccaggcccacaggcggcatctgtaaacgtgtgctgtcagtgaattgagccagcatgttcaagctggcaaaaatcacaggggcctttctcccacactgttttgtaaatgagtaaactaagactcagagaggactcacctgaggccttcttttttaacaataatagtaaaaccatcaacaaaaatgacatttgtcaagtgccacccaggaggatgttctagagtctgcccatgggcccgttgggatgctatgggtcctcacccacctcccagcccttctgctccccatctttccctggtggatggtgggccattggaatcctgggaggcctgagctggggagaggctcaggggctgggaggtgccctggggcctgcagggctgctggctcacagtgaggctgtttgtgccccaccacagggtcgctggacacccatcaagccccagcccaggccctgaacgagactcagtgggcactagaacgcctgaggctgcagctgggctccccggggtccttgcagaggaaactcagtctgctggagcaggaatcccagcagcaggagctgcagatccagggcttcgagagtgacctcgccgagatccgcgccgacaaacagaacctggaggccattctgcacagcctgcccgagaactgtgccagctggcagtgagggctgcccagatccccggcacacactcccccacctgctgtttacatgacccagggggtgcacactaccccacaggtgtgcccatacagacattccccggagccggctgctgtgaactcgcccccgtgtggatagtcactccctgccgattctgtctgtggcttcttccctgccagcaggactgagtgtgcgtacccagttcacctggacatgagtgcacactctcacccctgcacatgcataaacgggcacaccccagtgtcaataacatacacacgtgagggtgcatgtctgtgtgtatgacccacacgtgttcaagtctaatccatccagtcagcagcttacggtccacacacattacagtccacagctgttgtgagagccacctgtgtgctggacaccctctggatgttgggcaagttgttacatgagatgccctggggtgctacatccactcactccagatagcagggaggtctcagcagatctgcagagatcaagggggtcagcaacagccaaagcccctagtcccagagctggctgccctctgtttcacagcagctccctgacctgtgttgctgcgtgcactccctacagctcgacacagccaggggaccaacaggccaagaaatgcaagatcccgggagggttcttagcagcagaatctgaggcccagagaccctgaggccgtggccaggcctgctagtctggctagagcaaggcccattcctggcgggggtgtcattgccttcaccggacgcttccctctcagggtcctgggactgcaccagatgccctgagggaatggcccaccctggcctgtacccacttcagcctgtgatctatccaaagagccaggcccaaaagcgcctaggtcagggtgctcaggctaccaggagcacgcctctgtgcccccggcaacccagttgacctttaattgacgctttccagaccagccctgcggcaccacttgccatgcgggaggccaccagggtgtgcaagcctggctgccattccagtctgtcctgtctgggaatcgccctgtggccaggcccgcatgctggcctctgcccaggactcctcagcatttcctcttggcatccctcccctctcccagaccctcttccagcagatggcaaggcctcggcattgggaagtcaggcacctctgcgggcccagccccctcccgtggctcccctgacaggggcaggggtagggcagcagcacagaccaattccgttgaacgtggaaataaaggaccctttcactggg

SEQ ID NO: 1096 - DNA, 131828 bp, Homo sapiens
actcagttatttaatattttattatctatctcttttacataactacttgcaaaaaaaactaatatgacaaagccaatgtattatatggttataaacagaaacatatctgtaaacattagtattataagcagtgtaatattaaaggtggttatctatttgaaaactcagaaggcagtgacttctacaattaaatttcaaaaaatcaaaacataaaacattattagcttcagttactataaataaagcatccgaatcttaattttagagctaatggtaacttttaaataattcctaaatttcatgtaatctgttaagatatattttgttaacatttagaaaagacaagagaataagagaatcaaaaccaacgaattaaaggagctttataatttagcaaaactttcaacttacatgtctctcaaacattactggcaaacacaatgactgcttatgagaaaatctgcatatgtcattctacaaacagtaatgtcattaatattctatttttagtttccaagggaagatcctaaacataacaaatccttccgttagcatttcttcgtgtatgcatgttcctacttcctgttcaaacatatgctgtaactattcaagtacgtcttttcaaaataaaactgattaaccacccaaaaattcaaaaacccaccaacatccaagtgatattaggcacatatcacttgaacttgacattttaatgatgaaaagcaaatttaagaagcaaaaaaattaacatatttaaattataatttgcacatcagattactttttcagatgtgtcagagctcacagataaaagtaatgaaaagaaacgtggtaaaatacattttaattttaccttcattataaattaaaatgaggcgtaagaaaaacattgagaccataatatatacatatggaaaactggccactgaaagatgcaaataattcatacaatatagcgtaagctttcatatataaattatatgtcatttcatcaactgttagtatcatcagtctaaattttacaatatatattaaaatattaaaatgctaaaaaaatcattgcaatatagaatacactgtggcaaaatacgtatttgtggctttatagacaatctaaatccattctatacaatagttttctaaaatataaatggcagtttacatgcaaaagaacacaccagctggatgacctcatataatatatcagaaattaggagaaaacacccttttaacaagacagttacatagcagaggtggaatgtagaatcagattttgccttaatacaatcttggataaaattaattatgaaaaaggacagtctctattactttcagttagcattttaaaaaataaaatctactgtgattttatattttctaattgtatcacaaacagagaaaacataaaagggaaaagagagaaacagaaaacctgatgatcctttataaattggaagcatcagccctgcctatgggttgcatttaggctgcttttttgttgacattttcccaaattacttctgccattctgaattgtgcatcagtagtcagaggagttttccagacttcattatgccattgtgtaaccatagctgccacaatgtagtgccacaagaagtctgtccttgagtatttctttacttgggtattcaggtaacttgagcatgttgatgctttaaaagaaaaatataccaccattaaacaggaaatctataaaatttctgattgttttgcctagcagtgaaaacactactcataattaacataaaatcatcctcccaaatttgcattcagattgaaaaaccctaaagtggtatttaaaaagaagaaaaaatctgctgcattgcagtttctttcagcatgcaaatgcagtggaagaaaatacgttcctttcagcttaaaataaataagcaatagggcaatttagtttgaagtgatggtgtgtaactcagtgctacttacggtagtgtaactttagtgatacttgaactatagtcaattaaattgtagggagttagggcttcctcaaacattttccctaccaaaaacaggggcacaaaaaactacataattactcatcagtgattccaaaatcctggagagagatcacagctgaggttttcctcccaatgcagcaacagttagatctctgatcattcaaaattaatcaaaacaatttgtaaagcatttaaataaaccaagtcaacataccatgtgcttgaagttggtaaaagatttggagtatatggcacagcagcgattgtaaagttttgcaatccacttccacccatgatattagcaaacccaccatgtgggaccctggaactaagagtttatatcttaatacattgtaatcatgaaagaaagatatttgtgacagataaatttcaagttctaagttagggtaggaatatatccaactctaggacaatgacaacacgacactttttagtctacaaaactccaattcattactgtaagttgctttgtgattagttagcaagcttccatggagacacccctccacatttccataagctatactatgcttgcaactggccacagcacatacctcaatattgcatttagtatgctacatttacaattatttgctttcatgtggctctctattgaagtggggctgatttgagggcccaaacaagtcatatttacatctatatccctggggctagcaaaatgcctggagtagacattcattaaatgtttgttgaatagattaatattcgattgactaattcaagcaataaatgctctgacatgtaatccaaatgatttccttgtttgtgaaaaatatctaggccctaaagatttgttttgttttttatagtggaaaaactgaaaaattctttatgttcctctttgatttgatattcagaatatcaaatatatttttcaaacatcatctaacataatgaggccacaggaaggctaacatataatgcataacacatcagtagaaaatttaatcttgggtacatggctgtagaggatgtaattacaacttctcaagttctatacacatcaaaaagaaaattaatatttcttctaaagtttgcccgtgtatcatatcatgattaaactgatacaaaaaaaaaattctattgcttttaaaatgaggtgctgtagtgctttttggataaattagaaaaatgacaaaggaacgtttaatgtataggttactaaatacatacttgcaaacatctgaataaaatttaaaatactttcttaaaaatatgatttataacataaagcatagtttaggtcactgaaaaaaaaagttgaacctcaaatagcctaaacagtctagaaaaaaaagaacaaaggtggcagactcacatatcctgatttgaaaacttattacaaagctgtggtaatcaaaacagtgtgatactgccaagaaaagagacatatgaaccagtagaacagaatagaggccagaaataacccctcacatacataatgaaatgattttcaactagagtgccaacaacattcaaaggggaaaagacagtcttttcaacgaagtgtgttgggaaaaccggatattcactacaacgaaaatgaagttggacccttactttacactaagttacttaaaaactaactcaaaatggattgaagacctaaatctaagagctaatactataaaactcttagaagaaaatataagggaaaagtttcataatactggatttggcaacgatttattgaatatgacaccaaattgatatccagaacatacaaagaattcccatagaaaaaaaaaaaaatcccgattaaaaatgggcaaacaattgaaaaagacatttctccaaaaaaaagataaacaaatgcccaataagcacatgaaaagatgctcaacatcaccatttactagggaaatgccaatcaaaaccacttcacactcattaagatgactatcggcaaaaaatcaaaaaaacaaaagacagaaaattacaagtattggcaaggatgtggagaaattgctgctgggaatgtaaaatgatgcagcctctgtggaaaacagtatgcaagttcctcaacaaaattaacagaattacaatacagaattatcatatgatcaggcaattccacttctgggtatatatccaaaagaactgaaagcacggactcaaagaagtatctgcgcatacagcagcattattcacaatagccaaatggtagaagcaacccaagtgtccatcaacagatggctggattattatttagccaagggagtattatttagccttaaaaaggaagcaaattttgatatgtgctacaaaatggatgaatctagaagaccttatgctaagtgaaataaagcaatcacaaaaggacaaatattgtatgattccatgtatacgaagttcttagagtagtcaaattcgtagacataaaattggtggttgttagaggcgggtgggaaaggaggagggggagttagtgtttaaagtacagtttcagttgggaaagatgaaaaaattcagaagatggatggtggtgatagtcacacattaatgtgaatgcacttaatgccacaaaagtgtacacttaaaaattgtttaaatgatacattttatgatatgcatttacacacacacacaaatggttgaaaatatgcaccaggattgtctatttgaaatcactgatatgtatacatccacagggaaaaaaacatttaacaatccaatatgaaagaatccctaaaaacagcaattttctcttctatctgggaagtcgtctggtttggtttactgatgaaattcttgagcttactttaataaaccaaggcaacattaaaagtatgcctgaatcttgcttataagacactaatgcataaacaattcctattaacagcaagagaatatatacagaagacctggctatatctccttgtaagttgaaataaaattcaacattagttaatttatagatttaacttttgcctaaaaaattaataacgtgaccaaacataaaaagggataaaaatcaagtcgttctgaatttcctatgatgtcgaatttcaaattaaatgtaactattttatcaaggcaagatgagaaaataaatgttgacattgatttttatacaaattatagcacagtatttcaatatcaatatgatcaatctaatgtcctccacacaagtaaattttgaacggtaagttaaaaattcagaagatcctctagttttaacatcttaattaaaattattctataagctgataaaccattcctgaaaccttattcttttcctacactatgaataaatatggctggccccatacttatataatcagatctgatcatgttaagatcataattcatcaggcataagtatatatgagaaaaataaataaaacagtctttggttgaatattatgacacttagattatacagtataaaattacagtaaacaaaaatggcatatttctattttatttaaaaagtaattggccaggcgcggtggctcacgcctgtaatcccagcactttgggaggtcgaggctggtggatcacttgagatcagtagggaccagactggccaacatggtgaaaccccgtctctactaaaaatacaaaaattagccaggcgaagtgatgtgtgcacctgtaattggaggctaaggaaggagaatcgcttgaacccagaaggtggaagttgcagtgagctgagatcaaccactgcactccagcctgggcaatagagcaagacttcatctcaaaaaaaaaagaaaagagaaaaaaaagaaatcagccggacacagtgattcgcgcctgtaatcccagcactttgggaagccaaggcaggtggatcacttgaggtcaggagatcgagaccagcctggccaacatggtgaaactccatctttactaaaaatacaaaattagctgggcatggtggtaagcgcctgtaatcccagcgactcgggagggcttaggcaggagaatcacttcaacctgggaggcgggggttgcagtgagccgagtgagatccagcctgagaaacagagcaagactcttcctcaaaaaaaaaaaaaaaaaaaagaaatcatcaagtctgattcttaagggataatgaaacagtaaaacatttaagatggccttatagagcaacaaaatattaatgtcaatactataaaaatatttaaaaatcactttttgtattaattcttggttcaacaattggaacacgtttgatttttcagtaaggttgcgctaaattatactacagacctgtagaaagatacttcagtatctaaatataaactaatacagaatacagaatacagaatccaaaaattaaaaaagaaaaaaaatttatacttttggttttgaatgacaagtactatacctatactaatgactgggagttcgaggtaaaatttaagattttaaaaagcttaaaactttctcagtttgaactcaaaatatagagctctaattacactcaatgttgaaaggtgaattcttcaatccaagggtgaagctagctccgtgttgtttcccctcagcttccttggcttctactcttcacccacatctttcacctccattcaagtgtggatttgccacacttcataactaaataataaatagcacacctctttttcagcattgctaagaatgactgtactatttaaagtggagaaggcttgcatattactaattctagtgttttactctataggagcagccacctaagagacaacttagtactaaaaaacttgaataactgatttctgcatcttaaagactcatactgaccaaatcatggggaaaatatagtaattcactagatggtgttgaagtataaaccatttagaaaaatatacttgacaacataaatcaaaataaggtccggatggtttaaaaattggaatgtaaaaacagaaattataaaaacttacattaaaaaatttatataaacatatatataaaatcttaggagtagggaaggatttacaaaaaccacaaaggaaagcaatgataatcaatttggcaataccgtaatttaaaactttcaagttataaatttaaattacatggaaatctctatatttaactttgatacaccaagaaaactatttgcagagttaatacccctaatatataaacaacacttaaaactgaatttttaaaaatgattgtggaataccaaataataaagataggtaattcataccacacacaaaaaactatataaaataaattatatgaaagtaaaaatgggccgggtgcggtggctcacgcctacatgtaatcccagcattttgggaggccgaggcgggcagatcacaaggtcaggagatcgagaccaccctggctaacaaggtgaaaccccgcctctactaaaaatacaaaaattagccatgcatggtggcgggtgcctatagtcccagctacttgggaggctgaggcaggagaatggcgtgaacccaggaggcgcagcttacagtgagccgagatggcgccagtgcactccagcctggacgacagagcgagactccgtctcaaaaaaaaaaaaagtaaaaatgactataccctgtgctgataaaaggagtacattctctcattctctactgacatcaatacccttctagaagataaatgaatatatatcaagattataaaaatttatatattctcatacacaaaaatatcctaagaatttatcctctataatcagactgtcccacaaggatagaagcacaaaatattccttattcataaataggaaaatttagcaataaagaatcaattaaaggaagtccctaaaaataaaactagatagccattaaaaattacatagatctataaatttagtaacatattgctaaattcaaaaagttataaaataacaatagttttaaaagtaaaaattgtatatgtgttaaaaattctagaagaataacaaaaatgttatcagtgattatttttaggaatacagattggaagtggttttttttctcctatctgaattgtcaaattatcaactttcttacataaaaaatataattattttttcatcctttttattaagttattcaagcctctgagtatttcttggcattcagaggcaaaaaacaaaaacaaaaaaaagtttttcttttatatttttagtctataacctgttaatagttatgtcttatttatttattattttttattattattattattttttgagacagggtctcacactgtcaccccagctagagtgcagtggtgcaatctcggctcactgcaatctccacctcccaggctcaagtgatcctcccacctcagaaccctgagtagctgggaccacaggcatgcgccaccatgcccagataatttttgtatttttgtagagacggtttcgccatgttgcccaggctggtcccaaactcctgagctcaagtgatctgcccacctcagcctctcaaagtgctaggattacaggcactactataaatgtcttatctttaataccaaaacaaatctttaatacctaaaacagtgggaagggtggtaagttattgacaattcagagtaataattcctcgttttagttatctctaagccacaaaaacaatatattaaattatttccatattatcataaaaatactgcttacttggcagtaacaaactgcaagagaagtaccttgcccagcctatttattctttaaaattagatttatagtgtgagtccaactatttttctaactatacagtaaaaagactaaaaaaaataagcaaaatgttaattgtatgtatctctgaatagtgggatcacttaacattaaggattttaattttcttctattttctccattttccaaattttctacaatgattaaacactacttttaaaataaaaaacacagtttttaaaaattataggccaggcacggtggctcacacctgtaatcctagcactttgggaggccgaggcgggtggatcacctgaggtcaggagttcaagaccagcttggccacgatggtgaaacctcatctctactaaaaaaaaaaaaatacaaaaattagctggacgtggtggcaggcacctgtactcccaactacttgggaggctgaggcaggagaatcacttgaacccagggggcggaggttgcagatcgagccactgcactccagcctgggggacagagtgagactctctctcaaaaaaaaaaaaaaaaaaaaaaaaagaaaatttgggggaggagccaagatggccaaataggaacagctccggtctacagctcccagcgtgagccacgcaaaagatggtgatttctgcatttccatctgaggtaccgggttcatctcattagggagtggcagacagtgggcgcaggtcagtgggtgtgcgcaccgtgcgcgagccgaagcagggcgaggcattgcctcacttgggaagcgcaaggggtcagggagttccctttctgagtcaaagaaaggggtgacagacggcacctagaaaatcgggtcactcccacccgaatactgcgcttttccgatgggcttaaaaaacggcgcaccacgagattatatcctgcacctggctcggagggtcctaccccacggagtctcgctgattgctagcacagcagtctgagaccaaactgcaaggcagcagcgaggctgggggaggggcgcccgccattttccaggcttgattaggtaaacaaagcagcggggaagcccgaactgggtggagcccaccacagctcaaggaggcctgcctgcctctgtaggctccacctctgggggcagggcacagacaaacaaaaagacagcagtaacctctgcagacttaaatgtccctgtctcacagctttgaggagagcagtggttctcccatcacgcagctggagatctgagaacgggcagactgcctcaagtgggtccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccataagtagataaaaccacaaagatggggaaaaaacagaacagaaaaaccggaaactctaaaaagcagagtgcctctcctcctccaaaggaacgcagttcctcaccagcaacggaacaaagctggatggagaatgactttgatgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgtgatcaacaggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctatgtctgattggtggacctgaaagtgatggggagaatggaaccaagttggaaaacactctgcaggatattatccaggagaacttccccagtctagcaaggcaggccaacgttcagattcaggaaatacagagaatgccacaaagatactcctcgagaagagcaactccaagacacataactgtcagattcaccaaagctgaaatgaaggaaaaaatgttaagggcagccagagagaaaggtcgggttaccctcaaagggaagcccatcagactaacagcggatctctcggcagaaaccctacaagccagaaaagagtgggggccaatattcaacattcttaaagaaaagaattttcaacccagaatttcatatccagccaaactaagcttcataagcgaaggagaaataaaatactttacagacaagcaaatgctgagagattttgtcaccaccaggcctgccctaaaagagcctgaaggaagcgctaaacatggaaaggaacaactggtaccagccactgcaaaatcatgccaaaatgtaaagaccatcaagactaggaagaaactatatcaactaacgaacaaaataaccagctaacatcatactgacaggatcaaattcacacataacaatattaaccataaatgtaaatggactaaatgctccaattaaaagacacagactggcaaattggataaagaggcaagacccatcagtgtgctgtattcaggaaacccatctcacgtgcagagacacacataggctcaaaataaaaggatggaggatgatctaccaagcaaatggaaaacaaaaaaaggcaggggttgcaatcctagtctctgataaaacagactttaaaccaacaaagatcaaaagagacaaagaaggccattacataatgataaagggatcaattcaacaagaagagctaactatcctaaatatatatgcacccaatacaggaacaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacactacacctattccaaaattgaccacatacttggaagtaaagctctcctcagcaaatgtaaaagaacagaaattataacaaactatctctcagaccacagtgcaatcaaactagaactcaggattaagaaactcactcaaaaccactcaactacatggaaactgaacaagctgctcctgaatgactactgggtacataatgaaatgaaggcagaaataaagatgttctttgaaaccaatgagaacaacgacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggaggtggttttttgaaaggatcaacaaaattgatagaccgctagcaagactaaaaaagagagaagaatcaaatagatgcactaaaaaatgataaaggggatatcaccattaatgctacagaaatacaaactaccatcagagaatactacaaacacctctatgcaaataaactagaaaatctagaagaaatggataaattcctcgacacatacactctcccaagactaaactaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaatgtaatccagcacataaacagaaccaaagacaaaaaccacatgattatctcaatagatgcagaaaaggcctttgacaaaattcaacaaccttcatgctaaaaactcccaataaattaggtattgatgggatgtatctcaaaataataagagttatctatgacaaacccacagccaatatcatactgaatgggcaaaaactggaagcattccctttgaaaactggcacaagacagggacgccctctctcaccactcctattcaacatagtgttggaagttctggccagggcaattaggcaggagaaggatataaagggtattcaattaggaaaagaggaagtcaaattgtccctgtttgcagatgacatgattgtatatttagaaaaccccattgtatcagccccaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcattatcgtgaaaatggccatactgcccaaggtaatttacagattcaatgccatccccatcaagctaccaatgactttcttcacagaactggaaaaaactactttaaagttcatatggaaccaaaaaagagcccacatcaccaagtcaatcttaagccaaaagaacaaagctggaggcatcacactacctgacttcaaactatacgacaaggctacagtaaccaaaacagcatggtactgggaccaaaacagaaatatagatcaatggaacagaacagagccctcagaaataacgccacgtatctacaactatctgatctttgacaaacctgagaaaaacaagcaatggggaaaggattccctatttaataaatggtgctgggaaaactggctagccatatgtagaaagctgaaactggatctcttccttacaccttatacaaaaatcaattcaagatggattaaagacttaaacgttagacctaaaaccataaaaacactagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctagaatgaactcaaacaaatttacaagaaaaaaacaaacaaccccatcaaaaagtgggcaaaggacaggaacagacacttctcaaaagaagacatttatgcagccaaaaaacacatgaaacaatgctcatcatcactggccatcagagaaatgcaaatcaaaaccacaatgagataccgtctcacaccagttagaatggcgatcattaaaaagtcaggaaacaacaggtgctggagaggatgtggagaaacaggaacacttttacactgttggtgggactgtaaactagttcaaccattgtggaagtcagtgtggcgattcctcagggatctagaactggaaataccatttgacccagccatcccattactgggtatatacccaaaggactataaattatgctgctataaagacacatgcacacatatgtttattgcggcattattcacaatagcaaagacttggaaccaacccaaatgtccaacaatgatagactggattaagaaaatgtggcacataaacaccatggaatactatgcagccataaaaaatgatgagttcatgttcttcgtagggacatggatgaaattggaaatcatcgttctcagtaaactatcgcaagaacaaaaaaccaaacaccgcgtattctcattcataggtgggaattgaacaatgagatcacatggacacaggaaggggaatatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaaaaaaattatatatatgtattttatgtagatatatattcactattatgctttttaaatatgcagaaaaaacatagaagaaaatatattaaattgtttatagtggttatggctgatgggctatggtttttcttattctaattttctattttctaactttcctaggagaaatatgtacatttataatgaaaaaaaccaaactacattttcataaatagaagataaaattctgttatccaaaatgaaaatcagactttttttacatctttcagaaatacaagctaaaagatggttaaatcatctagttttctaatatctattatatttaactggttccaaaagtgaacttttcagagaagtgtagtaccacaaattattttttaggccatgaatcttgacactttaaagtttactttgaattacagaaaaactgttgtgtatgggtaatacagagttaaccaggataaactgaattgccttactattaaaccaaaccagcaatatacaaatattaaaatattaaaataatatacaaatattaaaaatttggctactatcattgacctacctgcagagcaaaaagatttccaaattataaagtacaatatactgataatcctaactggagatgctttttaatatattaagtaaacatgattgctcactactataaatgtcttatctttaataccaaaataaatctttctttaatacctaaaacagtggaaagggtggtaagttactgacaattcagagtaataattccttattttagttatctctaagccattaaaagcagaatacattaaattatttccatattatcataaaaatactgcttacctgcccgtaacaaactgtaagagaagaactctctcctcttgagtaatgtcttctacaacttcccagaaccactaacaacaagaacaaaaaacttagctcatatttcagagcaattgtagacttctcaataccagagaaatatgcaatattcataaagcacattttattctacaaaactcgtttaccaaaaatgatttcatgcaaagctttcatatgcactattcccacaagaataatttgggtaaacactttactttgttaattaatgtaagttttcatccaatagtgctgaaaagcttacaaaattaaacggcaaaacttaacttcattctaagctctagagaaattttacctgaataactggatcttctctttcatagccacttgtgtattctgtattttttatccaatcactcacatcaatttctggcatgccagaaagcagtagctccttgggggaagaagaaaaatatttcaataattttctttagggaaaaaagttattatatttaagtggtaaatttgccataattagaaactaatcccatgtaaaactgatatatttttgtgacagttcctgcatgtcatcaacaacaagcattacatgagagagaatccttgacgctgataatctcaaatattataagatgtggagatgtttccacattgatacaatttcattaaaacataagagattatagtttatatgtttatgtgtgaacatatgcaacaacagtttatatgtgcaaaagttttatgaacattatctttggtttactttatatttttacaattctttgcaattttgttaacttctgtaaggagacagtattctcaacatgaaagtgacaacaaagacccgaataaatacttgactaaacaaggggaaagtcatcaagaaatcattatcatgaggaaaaaggaggtaatataaaaatagttacgatttttaaaaaagatttaggccttttaggaattcaattctggaataatttggatcctgtaaagtcaattttctccaaagtcaaaaaaaatgcaattttcctaatgacttgataggtttattttatccaggaagatcatcaaagacacaaaatctcaatcgtataagtaaaaatgaaattaagaatggcaaagtatttacctttttgttttccaagggaaaagaggacatgaaaagagcttgtccacttctctgaatcagtccatatatcacagttagagatgcttacatagtcaggggaggcaatgattggcctacactttacactgatgattcagaatatcaggatttcctttttttttgagaccgagtctggctctgtcacccaggctggagtgcagtggcgcggctcactgcaagctccacctcccgggttcacgccattctcccacctcagcctcccaagtagctaggactacaggcgcctgccaccatgcccggctaatttttttgtagttttagtagagatgaggtttcaccgtgttagccaggatggtctcaatctcctgaccttgtgatccacccacctcagcctccaaaagtgctgggattacaggcgtgaaccaccgtgcccggccaggatttcttattacagggatgtagatgccctgtgattcaaaatcatgtctcctatagtaaactactcataacatatacctgaccttgtaccttaaataagattgatataaggcaacatctgagaactcttgagggtttccgagatctactcagtgggtccatgaggttctcccttttccaacttatctgtatgaggttgagttttcttcatatatttcaaccaaacaacataccaaaacagattatacacaaaagcagttgtaagggcccatttgtcttctactaagctagacattaaagaaatttgcaaaactgttaaacagtaccagtcttcccactgtttctgttttgttctggaaaatgcaattttagtttttcaaatgttctctatgttaatataataatggattattttatgtgaataaaatattttacatttctgttttaatttcaagtaaatatccattgacataacccacataaacaaaaactcttttgttttaaggggtcctaagaccaaaaagttttagaactgctagtatagggtgtgttttagtcctagtcacagtgttatagaatccttttcctagatgaagacagtctagtctacattgaccacccccaaatacattctctagcttcctttgcactgcagactggctgctttgcctgctggctgtcttgccagctggctttggtttgggtttggagcctgggaaacataggcagttagtctggaggtgagggtactctctgctcccccactgcttcagcatctctttgcagtagctatggctcctcaagtatggctaccatcaggtggcccctccttggtggttcaggctcccacggggctcttcacagtaattcctctacctgtctcttcagtcctagggatgataaaggctttccctgttgccagtctgtggatgtctcactagacattgtttattcttaacactgcccatacctctgtcatagtccctttgttaaagtttcgatatttgaaccatctggagaaattctgttccctgacaggactctgatataggtttgctaaaagggagtgggacaggctttacgcatgtcttacaattcatgagtttaatccttttcccttctaggctgaagataagctttcaataatattaagtatgctttcattattcataattatgaataaaaatgactaacattatattctctcaagaaatttgaagcacttcatgaatatcacattaattgttacgattttttttcaagaagaagaaaaagaaaggatctttattatcccatctggttactaaactgaccaaaaacaaacagatgaaatgagaattccagaataaaatgtacatattaagaaaaatattttaagccccaatcaatttttttaatacaacaaaataattgaattcatctgttggaactatgtgtaaggtatataactcatactaatagttagaaactgaatcatgaaagtattcataggcatcagcttacctagcatcacacgattcagtgtttttatattctggttctatcatggataaattcacaagcagcacagtatggaagaacagtccacagtcatctcttgatgccttctgtctacaatggatgactacacctccagttcagtacactggagctactcgataccttctcctcactaaaactctagaatttaacctgaatcctttaactcagatgcacatctagtttagacgtttgtaccaaattttttaaaagtttcctttctcagtgcagcatagccctcccctatgaaagacacaaagtcacacaaaaagttctaaagccaagtccctctgattactcatgccaccaagcagcagactggcaacagtgatggtatctggggtcagggaacatgagttcatagcctatcactaacacatgctctatgaccatgaacaagttccatatcttctttggcctagttttctcatctgtaaaatggggacaatagtactcacctcaagagattttttgtgagcgtttttaaagttaatacatataaaatacctggcaaatactaaatgcttaataattattattatcactgtataaatcaagaccatgcctacaatgttgctcttcccaaatgtgaatcagctcaacttagtaaagtcagagtccaagacaaactaggaacctgatctaaattttaatgtaagagccacaattaaaaacttaccagtaacagacctaaatgtgaaagataaaggaataaagcttttaaaagaaaacacagaaaaatatcttcacagccttggagtaagaaacagtttctaaaacaggacacaaaaagcttcttccatcaaaaaaaacaaaacaaaacaaaaaaaactgataaactgaactatgttaaaccccaaaatttttattcactgaaaagacctgagtagaaaatattcataatacatatatctgataaaagactcttataaaagaattcataaagagtcctacaaatcagtaaaaagaaaaaaaaacacaatagaaaagtgggcaaattacttaaatagacactttgaaaacagtacacaaatggctataatcataaaaggtgtgtaacttcattagctatcaggtaaatacaaattaaaatctcaaggaaagaccactactgaattaccagaatggaaatgaaaaagatggaaaattatcaaatgctagtgagaatgcagaacacccagaactctcacacctcctaatgggagtgtaaactgatgcatcacttgagaaactatctgctcctatctactgaaatggggtacatgcacagcctatgtcccagcaattccactccaaggcatataacctacagaatgcaaacttatgttttcctaaaggcatgtttatagcagcagtacttgaaagagcctgaaactgaaaagtacccactaaatgttcatcaagagtagaaaagactaaaggaaactgaaatgctatacagcaattaaaatgaacaaattaccaactgcatgcaacaatatgtatgattcccacaaacaaaaacttgagctaagaaagccagatacattctatttacataattctaaaataggcgaatctcgtctatgattttagaagtcaggagaatggttacccttaaggtgggagaatgactggagggagatgacagagtgacatatggggtgctagaatttctgtttcttcatctgggtgttagtttcatgggtatgttcagtttgttaaaacttatcaagctatacatttatgatgtgtgtccttttctgcatgtatatcataacccaaagttttataaacttattgatatcagtaaattacaaggcaaagttttcatcaattatttttgttgttgctatttgttttttacatacatataggtccagcaaataactaatgctctgttttgaatttcaaaaggctaatttaatccaagcacagtacaggaaaagccatattgcagtcaggtctaataatataatagctcaaatagtcctccatttttaaatgctgaaaatcacttctattgttacataaaaactagacaaatctatgctaactgaagccattaactgtacagcttaaaaacaatcaaaaaaacctcaaaacttacatttaatgaaactaaatcacaatggacttcaaaattaattagcaaattttattcactattatactaagatatactatgaatgataaattaaaaatactgatacatatgtaaaattaaaggtatatatccgtatctgtatccatatactaaaatgaaaggcatggggtaaaactaattttctgagacagaataaaaactaaataaaacatttccactgatctggaacttactattccaaattatatacttttaggtaagaaagcagctatatgctatttaaaatactgtgctttattaagatttagacaactcaaagagtttaaaaataattctccaaattaccaaaactaaagagaaaaagaaaatagagaaaaatgcagacataaatcatataaaattagaaatcctgttggatcacagtacaataaaggcaaattaaagtagcaaaaccaaacattcattagggactagaggatggcaaagacgatggactccataggtttgaaataaagaattataaaattatatatatggcaatataagaaactggagaagacaatactatacaataagaaaaaccttcttaattctttttagaagtttaagaagttagtatcagcgccctttacatcatgtggtcaaataaaaaattcagaaataatgtagaatactgtgtatataggaagactggccttcaacatctcccatatagaagaaacaggaatatattccattttagtttgtcaccacctcacctcacttcacattaaggagctgcttatctggttattaagcttaagagatgctcatccataaattttatatcaaatctctaaaaatggacattaaaccattttgtctcatttatacattatttcattcatcataatactccacaattatttctgaattacatcaactagagttttttgttgttgtgttacaacataagaactgatgtttttccttaccaattcatattcatcaaaaagctgtatgagggagggtggaatgaacatatgaaagccctgtaaaaaagcattgatctgaggctgaatggctcttgtcattcgaagttcagtaacaagctggacgtactccgcctgttgaaaaagaagttttcatgatgacttttcaaaaaccttttacatacttaatgttaatataattatttcttatttaagaggtaaaggtttaaaataaaattgacaccaacactcatacatctcagcaaatcagcaagccactattcactaagctgttgaggaaaaaattccagggactcaatcatccatgacttctctcacaccctatttcagctgatactatcagatctacctttaaaaaaatattctcaatcttaccttgtctcactacctccatttcagcaccccagtccaagctatcatcacttctcatctggattactgcaacatctggtgtccctgtttccatttttgcccctgtactgatgcttctccacatcttagccagagtgatttaaaaatatatatatgtgtatatacacatagatatacatgtgtgtgtatgtacatgtaaataactcagatccggcagctctcttgctcaaaaccctataatgacttctcatgacatctggagtaacatccaaattcctttcctggtctctaaggccctaaatgatctggcctctgccttgctctctgatctcacttctttccattctccccctagttcattcattcactcaattctagtttcactggctttctggctattcccaaaacacaagcttgtccgggccccaatgtgtttatacttctagatcattctcactgaaatgtctcattagaatgtaatctctctgcagacaggaactttgttttaccaggatatataccaacttctaaaaagtggctgccactttgaaagtattcaaaaaatatgtgaagaatgaatgcataccatcatcaaattcacttaacacatacttagaacttggtaaaatcattctttgtagcatagtcaattcaattctgagttaaggtaatctacatattcacccattttattttaaaatacgtgataatcatagaaaatattgttacttaaaatttaactggtaataagcagagggcatggtggcacatgcctgtactcctagttactaggggaggctgaggtggaagcattgcttgagcccaggagttcgagtctgcagtgaactatgaccgtgccaccacactccaacccgggcaacagggcaagatcctgtctcttaaagaaaaaaataataataataactggtaatttaaaaatgtattttggcttagaacaaaatgaattatatacagagagagaaagagtatgtgcctgtatacacatataaactattaggttatcatttatatattttttaattagttataagtgaaactttgtgagttaaaaacaatatgctatagcaggtatatagctcctacctactaggaattaatactctaacagggaagaaactctgttttagccctcttcctttatttttctttttttggcactaatctgatgctctgttcaaaaacaaacaaacaaaaaaaaccaaacaaaaaaaaaaaacaggggaaaaaaagaccaaaaaaaggcactgagccagcaagttctatatgactgctagctatgaattcttcacagctctcagagctacagaagtgtcacagtagattccatacagctctcccgaaaccctgtgtggctccttttataatttaacacaaggaaagctaccatctctgctattcaatctagtctcaccccaaattccacttcccaccaaccaaaggtgcaagtttttctctactatataggaattaatcagctacaagtcacatacaggtacttattatagagagggagacagaaatgtgtacccaacagtcaaacagaaacatacactaaatttctggagtccaacccgggaaataacatatataaaatatttcatagtgattacagcagtgatacctgcattagcacatgactatatttcagtttatgtctactctcactaaaattgttcactggatgtactaaaagttttctgccccattcatataattaattaattatatattatattttttaagatgccaggaaagaccctattcttccctaaagagactttttcccaagaggttttggctttaccatcttaaagtgtgactcaataatctctgtggaagaccttaacaagtcatgaagcatgaaaataaaagatttatgacttgctcatgtgaacgttacctattttaattgcattccatatctatcagaatagtatatactctattttttaccaattaattcctattatttcctcctacattttattttttaattaatttttacaaatataatactctttatcacacttttccttccatttattttaatatttattattttccacatgtatttcagtaacccagttcatagttattgataccaatttttgaaaatcagctccttcacatcccagtcttcatgccaattaagtaattcaaatgtggatggcagttgaactaaattatttttcaataaaataatgaaatcctagctatcataaacacttaatttttcagtaatataagagtttttcaaatacttgaaagagctgtgtttaatggaaaaatctaagtcgaactgcttctaaaatgtttccctgcctcgctaaacagtacaccttcaaacataataaaacaaattaatattatcttgacaatacaaattttactatgaacacccactactgttgcccagtaacatttcaagtgttcatgttgtgtagaaatacactggctaagggttctaaggacagcgctttggtatctcactgggaccgagctccggggacaaggggtgactgccatgtctggggttcagtcaactcagctgctcccacctgctggctttggagaatacaggcggtccagaaaaggtagggtccccttcaacacagcacatgtgctctaccaaaaagcagccagactgcttctttaggcaagtccctgatcccattccttgtgacttgttaagatctcccagcaggggtctccagccacctcttataggtgcatgcaggccaacaacaggtaagtacctaccccctgggacagagcttccagaggaaggacctgcctgccatctttgctgcttcatggccttctctgctgatacctccaggtatgggagaaaccaaggcaactggggtctggagaggacccctggcaaaccacagcagccctatatacagtaaagtggccagattactaaaagaaaaacaaatcaacagaaaacaacaacaatatcaacaaaaagaccccacaaaaacctcagtcaaaggtcagcaacctcaaagaacaaaggtagattaaggccaaaaagatgagaaagaatcaacacaaaaatgctgaaaactcaaaaagccagagtgcctcttctcctccaaatgaccgcaacacctctccagcaaaagcacagaactggtctgaggctgagatggctgaattgacagaaatagtcttcagaaggtgggtaataataaacttcactgagataaaggagcatgttttaacccaatgcaaagaagctaagaatcacaataaaacaatacaggagctgacagccacaacagtcagtttagagaggaacataacagatctaatggagctgaaaaacacaacatgagaacttcacaatgcaatcacaagtatcaatagcagaatagaccaagcagaggaaagaacctcagagcttgaagactgtccaaaataagacaggcagacaataatagagaaaaaggaacaaaaaggaatgaataaaacctccaagagatatggggttatgtaaagagaccaaacctatgactgactgaggtacctgaaagagacgaggagaatggaaccaagttggaaaacatacttcaggatatcatataggagaactcccccagattatcaggacaggccaacattcaaattcaggaaatgcagagaaccccagtaatacactccacaaaaagatcaaccccaagacatataatcagatgtgtcttcacatcagattccccaaagccatcagattccccaaggtccaaatgaaagaaaagctgttaagggcagccagagataaaggccaggtcacctacaaagggaaacccttcagactaatagcaaacctctcagtaaaaaccctgcaagccagaagagactggtggccaatattcaacattcttaaagaaaagaatttccaactgagaatttcatatctggacaaactaagctttataagcaaaggagaaataagatccttttcagaaaagcaaatgctgagggaatttgttactaccagtcctgccttaccagagctcctgaagaaagaactaaatatggaaagaaaaaattgttaccagccactacaaaaatacactgaagtacactgaccagtgacactatgaagcaaccacataaaccaagcctgcaaaataaccagctagcatcgtcatgacaggatcaaattcatacataacaatactaacattaaatgtaaatgggttaaatgccccaattaaaagaccaagaatggcaagctggatgaagagccaagacccatcagtatgctgtcctcaagagacccatctcacatgcaaagacacacacaggctctaaataaagggatggaggaaattttaccaagcaaatggaaaacagaaaaaagcaggagttgcaaccctagattctgacaaaagagactttaaaccaacaaagattaaaaaaagacaagggcattacataatggtaaaaggttcaattcaacaagaagtgctatcataaatatatatacaaccaacataggagcaccaaattcaaaaaacaagtgcttagagaactgcaaagagactgagactcccacacaataatagtgagaggctttaacagcccactaacaatattagacagatcatcaagacagaaatttaacaaagatattctggacctgaactcagctctgtatcaagtggacctgatagatatctacagaacttcccaccgaaattcaacagaatatacattcttctcatcaccacatgacacttattctgaaattgatcacataatcagaagtaaaactttccttggcaaatgcaaaagaaatgaaatcataacaaacagtctctcagaccacagcacaatcaaattagaactcaagattaagaaattcactcaaaaccacacaactacatagaaattgaacaacctgctcctgaatgactcttgggtaaacaacaaaattatgggagaaatcaagaatttatctgaaactaatgagaacaaagagacaatgtaccagaatctctgggatgcagctaaagcagtgttaagagggaaatttatagcactaaatgcccacatcaaaaagctagaaagatctcaagttaacaatctgacatctcaactaaaataactagagagccaagagcgaacaaactccaatgctggcagaagacaagaaataaccaagatcagaggtgaattgaagaagacagagacacaaaacaacccttcaaaaaattcaatgaatccaggagctgattttttgaaaatattaataaaatagatagacctctagctagactaatgaagaaaagtgagaagaatgaagtaaacacaatcagaaatgataaggtagatatcaccactgaccccaaagaaatataaacaacctgccaggcacggtggctcatgcctgtaatcccagcactttgagaggctgaggtgggtggatcacaaggtcaggagttctagaccagctgggccagcatggtgaaacgtcatctttactaaaaacacaaaaaattagccaggcatggtggtgcatgcctgtagtctcagctactcaggaggctgaggcaggagaatttcttgaacccagtaggcagaggttgcagtgagctgagatcacaccactgcaccccagcctgagtgacagagccagattccatctcaaaaaaaaaaaaaaaatatatatatatatatatatacacacacacacacacttattattaaagtcacaaactagttataagaattgatagtctgataaaaatcctattacttcagcttccttgagacaaattcagtcattgaaaatagtgatcgaagagtcgtttccaagatggccgaataggaacagctctggtctacagctcccagcgagactgacacagaagatgggtgatgtctgcatttccaactgaggtgactggttcaactcattgggactggttggacagtgggtgcagcccacggagggcgagccaaagcagggcagggtgtcgtttcacccgggaagcgcaaggggtcaggggttttccccttcctagccaagggaagccgtgactgactgtccctggaggaatggtacactcctgcccaaataatgcacttttcccacagtcttcgcaactggcagaccaggagattcccttctgtgcctggctcagagggtcgcatgcccatggagccttgcttgctgccagcacaggagtctgagattgacctgggtcgctggaccttggcggggagaggggcgtccaccattgctgaggcttgagtaggaggttctctgctcacagtataaacaaagaggcagggaagcttgaactgggcggtggccactggagctcagcaaggcctactgcctctctagattccacctctaggggcaggacgtacctgaacaaaaggcagcagacagcttctccagacttaaacatccctgcctgacagctctgaagagagcagtggttctcccagcacagtgtttgagctatgagaacagacagactacctcctcaagtgggtccctgactcccgtgtagcctgactggacacctcatacaggcgggtgcccctctgggacgaagcttccagaagaaggtacaggcagcaatatttgctgttctgcagcctccgctggtgatacccaggcaaatggggtctggagtggacctccagcaaactccaacagacctgcagctaaggggcctgtttgttagaaggaaaactaacacacagaaaggaagagcatcaacatcaacaaaaaggacatccacaccaaaaccccatctataggtcacaaacatcaaagccaaaggtagataaaaccacaaagatggggagaaaccagagcagaaaggctgaaaataccaaaaaccagaacacctcttcacctccaaaggaacacaactcctggccagcaatggaacaaaactggatggagaatgagtttgatgaactgacagaagtaggcttcagaaggttggtaataacaaacttctccaaattaaaggagcatgttctaacccatcaccaggaagctaaaaaccttgaaaaaaggttaaacgaatggctaactagaataaccagtgtagagaagagcttaaatgacctgatggagctgaaaaccacagtatgaaaacttcatgaagcatacataagctccaatagccgattcgatcaagtggaagaaaggatgtcaatgactgaagatcaaatcaatgaaataaagtgaaaagacaagattagagaaaaaaagaatgaaaagaaactaacaaagcctccaagaaatatgggactatgtgaaaagaccaaatatacatttgattggtgtgcctgagagtgacggggagaatggaaccaagttagaaaacactcttcaggatattatccaggagaacttccccaacctagcaagggaggccaacattcaaattcaggaaatacagagaacaccacaaagatactcctcgagaagagcaaccccaagacatataaaatgtcagattcaccaaggttgaaatgaaggaaaaaatgttaagggcagccagagagaaaggtcgggttacccacaaagggaagcccatcagactatcagcagatctctctgcagaaaccctacaaaccagaagagaatgggggccaatattcagtattcttaaagaaaagaattttcaacccagaatttcatatccagccaaactaagcttcataagtgaaagagaaataaaatcctttccagacaagcaaatgctgagagactttgtcaccaccaggcctgacttgcaagagctcctgaaggaagcactaaacatggaaagtaacaaccggtaccagccactgcaaaaacaagccaaactgtaaagaccatcgacgctatgaagaaactgcatcaataaatgggcaaaataaccagctagcatcataatgacagcatcaaattcacacataacaatacaaaccttaaatgtaaatgggctaaatgacccaattaaaagacacagactggcaaattggatagagtcaagacccatcagtgtgctgtattcaggagacccatctcacgtgcaaagacacacataggctcaacataaagggatagaggaagatctaccaagcaaatggaaagcaaaaaaaaaaaagcaggggttgcaatcctggtctctgataaaacagacgttagaccaaagaagatcaaaacagacaaggaaggacattacataatggtaaaaggatcaatgcaacaagaagagctaaatgacctaaatatgtatgcacccaatacaggagaacccagaatcataaagcaagtccttagagatctacaaagagacttagactcccacacaataatgggagactttaacacctaactgtcaatattagacagatcagtgagacagaaggttaacaaggttatccaggacttgaactcagctctggacaaagcagacctaatagacatctacagaactctccaccccaaatcaacagaatatagattcttctcagcaccacatcgcacttattctaaaactgaccatataattggaagtaaaacactcctcaggaaatgtaaaagaaaagaaatcacaacaaactgtctctcagagcacagtgcaatcaaattagaactcaggattaagaaactcactcaaaactgctcaactaaatggaaactgaacaacgcgctcctgaatgactacagggtaaataacgaaagtaagtcagaaataaaaatgttatctgaaaccaatgagaacaaagacacaacgtaccagaatctctgggacacatttaaagcaatgtgtagaaggaaatttttagcactaaacgcccacaagagaaagcaggagagatctaaaatcaacaccctaacatcacaattgaaagaactagagaagcaagagcaaacaaattcaaaagctagcagaatacaagaaataactaagatcagagcagaattgaaggagacaggaacatgaaaaacccttcaaacaaatcaataaatccaggaactagttttttgaaaagatcaacaaaatagatacacagctagcaagactaataaagatgaaaagagagaagaataaaatacatgcaataaaattataaaggggatatcaccactaatcctacagaaatacaaactaccatcagagaatactataaacatctctatgcaaataaactagaaaatccagaagaaatggataaattcctagacacatacaccatcccaagactaaaccaggaagcagttgaatctctgaatatatcaataagaggttctgaaattgaggcaataattaatagcctaccaactaaaaaaagtccaggaccagtggattcacagccaaattctaccagaggtacaaagaggagctggtaccattccttctgaaactattccaatcaatagaaaaagagggaatcctctctaacttattttatgaggccaacatcatcctgataccaaagcctggcagagacacaacaaaaaaagagaattttagaccaatatccctgatgaaaatcaatgcaaaaatactcaataaaataccggcaaaccaaatccagcagcacataaaaagcttatccaccacgatcaagtcggcttcatccctgggatgcaaggctggttcaacatacacaatcaataaatgtaatccatcaaataaacagaaccaacagcaaaaaccacaattatctcaatagatgcaaaaaaggcctttgacaaaattcaacagcctttcatgctaaaaactctcagtaaactaggaattgatggaatgcatctcaaagtaataagagctatttatgacaaacccacagccaatatcatactgaatagggaaaaaaacgggaagcattctctttgaaaactggcacaagataaggatgtcctctctcaccactcctattcaacatagtattggaaattctggccagggcaatcaggcaagagaaagcaataaagtgtattcaaataggaagagaggaagtcaaattgtccctgtttgcagatggcatgattgtgtatttagaacaccccattgtctcagcgcaaaatctccttaagctgataagcaacttcagcaaagtctcaggatacaaaatcaatgtgcaaaaatcacaagcattcctatacaccaataagagacaaacagagagacaaatcatgagtgaacttaaattcacaattactattaagagaataaaatacctaggaatacaacttacaagggatgtgaagaaccccttcaaggagaactacaaaccgctgctttaaggaaataagacaggacacgaacaaatggaaaaacattccatgcttatggataggaagaagcaatatcataaaaatggccttactgcccaaagtcatttatagattcaatgctatctccatcaagctaccattcacttttttcacagaaatggaaaaaactaatttaatcttcatatggaaccaaaaaagagcccgcatagccatgacaatcctgggcaagaagaacaaagctggaggcatcatgctaccagacttcaaactatactacaaggctacagtaaccaaaacagaatggtactggtaccaaaacgatatatagaacaatggaacagaacagagccctcagaagtaacaccacacatctaccaccatctgctctttgacaaatccgacacacataagcaatagggaaaagattcctttttaaataaatggttttgggaaaactggctagccatatgcagaaaactgaaactggaccccttccttatactttatacaaaaatcaactcaagacggatgaaagacttaaacgtaagacctaggaccataaaaatcctgcaagaaaacctgggcaataccattcaggacataggcatgggcaaagacttcatgtctaaaacaccaaaagcaatggcaacaaaagacaaaattgacaaatgggatctaattaaactaaagagcttctgtacagcaaaagaaactatcatcagagtgaacaggcagcctacagaatgggagaaaatttctgcaatctatccatctgacaaagggttaatatccagaatctacaaagaacttaaacaaatttacaagaaaaaaacaaacaaccccatcaaaaaatgggcaaaggatatgaacagacacttctcaaaagaagacatttatgcacccaacagacacatgaaaaaatgctcatcatcactggtcattagagaaatgcaaatcaaaaccacaataagatactgtctcacaccatttagaatggcgatcattaaaaagtcaggaaacaacagatgctggagaggttgtggagaaagaggaacacttttacactgttggtgggagtgtaaattagttcaaccattgtggaagacagtgtggcgattcctcaaggatctagaactagaaataccatttgacccagtgatcccattactgggtatatacccaaaggattataaatcacgctactataaagacacacgcacacgtatgtttactgcagcactgttcacaatagcaaagacttggaaccaacccaaatgtccatcaatgatagactggattaaggaaatgtggcacatatacaccatgaaatactatgcagccataaaaaatggtgagttcatgtcctttgcagggacatggatgaagtgggaaaccatcattctcagcaaactatcacaaggacagaaaaccaaacactgcatgttctcactcacaagtgagagttgaacaatgagaaacacatggacacaaggaggggaacatcacgcaccagggcctgctgagggtggggggctagaggagggataacattaggagaaatacctaatgtagctgacggtttcatgggtgccacaaaccaccatggcacgtgtatacctatgtaacaaacccacacattctgcacatgtaacccagaacttaaagtataattttaaaaaaaggccgggcgcggtagctcacacctgtaatcctagcactttgggaggccgaggcaggcagatcacgaggtcaggagatcgagaccatcctggctaacacagtgaaaccccgtctctactaaaagtacaaaaaattagcctggcatgatggtggacacctgtagtcccagctactcgggaggctgaggcaggaaaatggtgtgaacctgggaggtggagcttgcagtgagctgagatcgcgccactgaactcgagcctgggcaacagagtaagactccatctcaaaaaaaaaaaaaaaaaaaaaagaatcagtcaaataagaaataaacaaatttcccagcaaataaaaagaaaatactggtcattcaggttaccattttataggtttggtaatttttaaagttaatttctagaatatactatctaaaatgcaaggagaagtgtgttttcatgttttcattgttgacaggaagataccaaaaagatcattcaaacccacctaataacacacacgtatactcaacatgaaaaaactgtagacttacactacctgttttaaaagttttcagagtagtaaaaaaacaaatctcatagtacagattgagtatcccttatccaaaatgcttgggaccagaagcgtttcaaatttcaaagtgttttagattttggaatatctgtatatacaaaatgagttatcttggcaatgacacccaagtctcaacatgaatttgtttcattgaaccatcagaaagtaaagggatcactatctcagccacccgtgtagacacaatctgtggttgtttgacatcaccattattcctgaccaaatttacatgttaccaataagcaaccattttcttacacttacacctaactacttaatggttaaaaaaaaaaaaggggcataccattaatacagtgaaaaaaatcacatgttcagggtagctacagcagcacagaggcatcaccagaatatctgtgccagctgttaaacagaagcaacaaacagcaggctttctgtttccatctggaatgctttgttttgattaaaaggtactgtaggccaggctcagtggctcacgcctataatcccagcactttgggaggccgaggtgggcagatcacttggggtcaggatatcgagaccagcctggccaacatggtgaaacctcattcctactaaaaatacaaaaattagccaggtgtggtggtaggcgcctgtaatcctaactacttgagaggctaaggcagaactgcttgaacctgagaggcaaaggttgtagtgggccgagatcccaccactgcactccagcctgggtgacagagcaagattttatctcaaacaaacaaacaaaaaaaaagtactgcacactttttattttttgtgagacagagtctcactctgttgctcaggctggagtgcagtggcactgtgatcttggttcactgcaacctccacttcccaggttcaagcaattctcctgcctcagcctcccaagtagctgggattacaggcacgcactaccatgcccagctaatttttgtatttttagtagagacggggtttcaccatattggccagactggtctgaaactcctgacctcaggtgatccactcacctcggcctcccaaagtgctgggattacaggtgtgagccactatgcccggcctgtacattattttatgttttaaggtgagaagaagcagttgagaggacagcaagtgggtcttctaggaatgaggagtcattctgctggatggatttttaaatgtttcctccagggttatctgcctcattaacaatggtgtttgccttagaaatctctctttgattttataaactaacatgatttcttgttctgttgtgaatgccatattttcaccatgtcatctataggcacttcttcttcagttttaatgttatcttcatcatcactattatcaccatcacctacactcagaaccattttggctacttcatcatcaatgaatgagcaattggagccttataaccagtgttacagaccttttcaatatccacttctttcagttcactaacaaactctgaaggtatatttttttgcatatgtaaggcagtcaaacatcatttctttcacttgacatacagaatccttcaaagtcacacatttgctcgtcaccatcactgaacatagttgcaggccagaggttgtgccaggcatgcacaattgtgtctttactcactgtgttccaagcactggcaacagcatacacaacatccttcatattaaactccctttgaaaaccttccacaattacaattctgttcactgatgctagcagtctatgcaacaaagtgttatatttattcttcactgatctaatgtgactgattaattcagtcacatggctgaattaatgaagtcacatttgagggaaaatacatggcaaacacattatttttgatgagaatttcagctggatgatgagcagagcagttgttagggaataacaaagtcttgcagtcaccatgcagtaaacacaagccactggtataaaatattttccctggtgatccatgcctttttgctagcataataatggactggtaagaaattcactccttgaagagattgagaacacaggcttttgcctatcatggcaaatttacacttacacttgcctgttgcactaggacatccctgcacatttattctgtccttggtagcctaccacaggggctgtctcatcagctgtagtcagtgtctttctgaggcaacaacaacaaaatagtgatattttaacagcaatatagacttgttctagcatcagattttcatcagcaatgaccttggcaaattcctcactgaatttcaccactgttttgtgatcagcagatgctctattgccacaaatctttaaaaaatgaatatcatgtctcttcttaaatttctgcaaccagcctgttgaaaagtcagagttcccttcaattttcacttcattatgatagatctttgcttgtttatgatcggcataccattaagtggcaagtgttcactgttaggctgacaaatccactctttaaatacacaattgagatcttcagttttagctttatgcagtgttattctatttttcattaacttcttttcatcagttttggcacagaacgtcaacagtttattcttttgtttcttcaagttatatagtgtggtcattccaacaccatactcttctgtaggacatttcacatttatattgctgtccagtttctccaacagcttgactttctgtgctacggataaagacaaatgctccctcttttccctgtcactgttacccacaggggtatctgcaggcctttttgacattcccaacaatacctctgcaccacagagcagaaaataagcaaaagaaaagaaaagacatgagtaatgcacaaatgcacatcggccttggccccacgtggggcacagtggggaacctgctcttggcatatgcgtcctgcacatgtcatttattacccttgtgggcatgcttgcatgatggaatcttggtgtgttgaagaaaaaatatatatgcagcagaagggggctgggagggtcttttttcctttggggatgctgaaacaactgtatgttgtatgcttgtgttctgagtgccccctggtcatatgagatcaggtatgggatttaccacttatggcttcatgtcagtactcgaaaagtttcagactctggggtactctgaattatggatgctcaacctgtatacttttctaaagatgcatataaagaatccactttaagtcaataatctatggataaaagtctgtattttgtgcttgtatgtgcattaaatgtgtatgttaaataaatcatgcaaagctagcactaaaaatttaatcatataagactagcaataaaaccatattaaaatgaaatcgttaaaacatactaaatttgtatttgctactttgttcacattcactgccttagtaaatgagaagcctagcagttacactgtcttatagacatccatttaaaataagaaaacatcagttacaagttttgtgccctcgggcagttatttaacgtctaaagaaatgcagtgttgtagttacaagcaggctcaagtgcttgtctcagcagcacgtatactaatattggaaccatacagagaagactggatggcccctgcacaagcaggcttgaaatttacagactgcatggagaaagctacttagctcctatatgcttctgtttcctcacctgtagaaaggggtatctccacctcacagagttaagtataatacccataaggcacatcaaacagtgcctagcacattataaaaacctaataaatgtcaaatgttttaatattaaggctgtttccacactaaataaagagaaatagctatctcaagaggctgttacaggaaatgagaaacataaagaacatggttcagatacatgaaacacaaagcactcaataagtagtaattattatcactaaaaaacagaattaatgataatgaggttgatgaagagtatgatggcaacactatcagacattaggtggcccaatccacaacagtggcagttatccttgagtccttcctctttctcatcttcccaattaccaagttctataaattctattatcctcaaaagcttaaaagctattccattttctccatcttcactgccacttgccttacataattcttcatgcatgcttccccaaaccaaaatgccacagcctcctctcagttgtcctgactctagtaccgccccatttcaacccatttttcacactccaagctgagtttggttgtttctttttgttttcttaactgaaatttgatcatgtcatttccctctttaacatctgcaatcatctccacagacttcagaataattttcaaagtactatttgtggatgcaaagtctttcagaatttggccactttctcccttccccacatcatctttttctacttgcttacttttccatctaagctaagctccacaactctgatctacttgtggtttcccaaagcatgctctgtcacctctgtgccttcctgtaagcccagaacatttccttcttcccatccttactcctactcgaccacttaatgcttcacctctataattcaacttccataccacttcatccattccctgatacctgccccatcttactcttatcttcttttttttctccaagcctggatgaactttatgactaatattataaaagtgatgctaacatttaaacccctacagcttcaattctaaatgctagaactgaaaatatgagcaaaagaggccatatctaactaatttaagagtattatatttcaaatgtggaactaatatatatacatctgcctatattgcttgtatttatttaacatattgctttttaaattaaaggtattttcatctatttggtttcactttataatcaccaaagccttttaataaaacttgggaataagggactcccccatgtggagatcagtttacaaaggccctctaacaagtttagcaagtcatttaagtttcaatagttcaaaattataaagtcgaactctaaacatgacaaaaaaactttctacctataaagtaaaaagctgactctaaagtaacagaaaagttcataacagaatgtataagcaaaaaaaaagaacaaaccaaaaatcaatagtatttccaagaaacagggtttgaaaattttaaagtaacattttgtaaactgaatatcttaacaattttaagcaaggtaaaatgtgatgtgtttctaaagatttttaagagttttatatgaatcaggttatttattaaataagcattatatgttgaaacctcaacaatttgatacacaattactatactggtaacattagaaaaaaaaggctcaatttattgtgagaaatgtttatataaaaaaaatgaaagctgagaatgtataacattaataatcaagaccctgctattaacactcctaattacttaaaaaagttagcctctaatcaaccaagcaattaaacaaaatgtaaatatatatagtattaaactgagaaacaaaagtttcaagctctttaatattaaaatagtattcccacctctggtgagatgcacaatgaagggtatatcctcaatgtgagcatattcttacttattcttatttattcaatattttccatctttctagatttcattaaaatacacaaatacaaaaaaattaataatattttaaaaatctaaacaaaaatcatgtcatagtaagggggggtgctgctaggagatgcaagcataaatatagatatacctcatacacatttttttttcttttttaagtgataggatcttgctctgtcactcaggctagagggcagtaatgtcatcttggctcactgtagcctcaacctccagagctcaagtgatcctcccacctcagcctccagaatagctaggactgtagccacacaaaactaggcctggctaatttttttattttttatagagatgaggtctcactatgttgcccaggcttgtctcgaactcctggcctcaagcaatccccctgccttagtctcccaaagcactggaatacaattgttactagatctttccactttgtcatatatatctgaaaggagtgacaaacctcaccagatatagtattcacagataagaatcatgtttatggttctcttatcaaaggcaatcattgcttaataaagattctatgacttcattacccttaattgagggtaggcctccagtgtaaaataaaataataaacatgctacaaggtgaacaatctaaaaaaagattctaaaaatattttcactcactggcaaatcatataggtttaaaaattaagtgtttaactattataatcttctagagcttaacatgacttacattaaaaatcaagtaagttcttcctcgacacaattaattttgcatatagtatgaagaacattagacttgaaattaggaggcttgggttttggccccagttttgccattaactctttaggattagtgtcatttcatgtaaaatgagagggtagaatttaaaatttctaagtatgaatatgtaagaactcaactcctgactttatttccaagaattcaatctcttttttttgtacactatagtatcttaagtttcaaaaggtaaaattatgtcgcttgctaataagtttccaattccctttatatatctgaaactaagaacctatttttatagaaaactacccaatacaactaacttttgtgctgtgcttttcattttacaaaatgctaataacaattctgtatgggaggtattattattccaattctacagaaaactgagttcgaagaattgttaaacataaccctttttaaaataatccacattttactaaatctatagtttaaaaaatggctcagtgaacattgtttcttatagttaaattgattctgaagatgtcttggaattataattcagctaaacaaaaagggaggggggcagtttagtattgttcaaccagaagctgctacttgtaagcaacagaactagaattcatatgatattttctaactccaaatacctcatataacatattaaaacaccaagccatattaaatcttaaagtcatattatgactttgaacagtgaaatttaaaacatatgcaaagatttttaaataatacatatagaggagaggtaataataaataaaaataaggccgagagtggtggctcatacctgtaatcccagcactttgggaggccgaggcagacagatcacctgaggtcaggagtttgagaccatcctggccaacatggtgaaaccccgtctctactaaaaatacaaaaattatctgggcatggtggcgcacccctgtaatcccagctactgaggaggccaaggcaggagaattgctcgaacccaggaggcagaggttgcagtgagccgagatcataccactgcgctccagcctgggtgacagagtgagacttcgtctcaataaataaataaataaataatcaagttatacagtcaaaaaaatatcaaaaggtcgaacaaacttactggatcccaaaagtatgtggaaagcttaaacactggcatttcttttctctattagaattctttaatattacactttaaaaacatgaaagagcaatttttgcaaatatcttcatttaagcttatatttctaatcaaatttctcaaaatgcatatgcccaatttatactatcagctgaagtgctctcgattttttaggaaccaactcagcacagctagcacaattatcaaaataatcctttctaattcaaaatttaacatttgattgttttattaacttaaacgttttatctgctatgatactgtaatagtaaaagtttttctacaagtgccagaagaatttagagtaactagcaaactatcagggccaagttacaaacaatggttaaggtaaaaactgaaatactcactttattattttgtgtcacaagaatactcccacccccaggtttcaaaggcacctcttccattgctccaaacacatcagtctcaacagaaaaagttagttctagacccagatcacttatatcattatctaaaatccattgcaaatttttcgcatattctggatcaatggatgccacatcttggtaatttacaggaatacctaaaaaatgcaaacatacagcagttatagtctggttttgccttcccttatctatttaatggtaaaatactgccctctacagatattctgaaaaactgcaaaatataatacaatcctacacacagcatattttaaatggattcctgaatttgaaagtctgttaaattaattctgtgtttctttcacattgttacaatgtaatctttctttgaaataactattcaggaagttattataaacttcaaaaatgccaattatcttaagtatactcacactgaaatgtattcttagcataaaaatacacacacaaaaattgaaaaaaaaaaaaaaaggctaacttaactagaggtgtttggaaaaaaaaaaggtaggtcatttttttctccttcaaaccccgaatggcttacatatacagatgggctccaatcaaaataaaaattatctcatccaaaatactactgcttatctagttttcctcaaactgaaaaaaaaacaatataaataaatgtctgcagaaataataatagagccataccaagaatgtgcttgtagaaggatcgtgtgaagtaaatattgaccagctgcctgtggttcaacgctaatcccaagatctgcccagcaaaccgaaaatagttcaagtgatcaggatttacataagagttgctattaggctgaaaagttgttcctattgaaataaatacaaaataatatattattaagaatctatatgcagaagaaagattacttcgatgcagataaactaattcacatacaacttcagcaaagctaaggttacattatgtataaacttccagagaaatgttctttgtggaaaatataacaagtggtaagtagaattggaagtatagatgataatcatttattcatacatatttgtcacagtaatctatggcagagagaaaattttagagtacttttgactgaaattagttggaagatcatcagagacactctggaaataatacagcagaggatcatatacacatacacatacacacacacacacgcacatatacacagtttcctaggcagtatggcaataggctgttcgctaggacagacattatcccattcatctgtatgtgccagtgcagtaagtatttgctagtttttgctgcttcaggagtagaacactatgagaataactaaaaactgtaaatgtacaactgctcttaagtgacaggcctagtcaatgaacttgatgcctgttaacaatgattagaaaatcacctcagtccacaaggtaaccaagtctttctaatggcaaacaattaagtttaaacaattacctctgaggtgaaagtaaaaatggcaagggcaataagttaccaattactatgaaaatccagtgcaatggaatatgaatccacttttataaaatatctagaataggcaaatttatagataggtaaagtagattagtagttacctaaggctgaggaaaggggatatgggagatattgcttaacgggtacagaatttctgcttggggtgatgaaaaagctctgaaaatagatagtggccgatggttgcacaacactgtgaatgtacttaaatgccactgaattgtacactttcaataatataaatggtaaatttatatgtgtatttcaccaccgtaaaaaaaaagtctcaaaaaaaaaatactactagttaaaagttaaaacctaatgccaaaacctcaactttaaataactttcttttcctatttttcctatttttctgtgatggtcactaattcatattacaaatttactcatccattcaacaaacacataatgagctcatgctatatactactattgtaaatgcctgggctaaaagaaacaacggataaacctaatgaaatagcatcaaagaaaaacaaaaggtagaaatgtattggaaagtgaaatctttagtcattttgacaataattcactctgtgtttcactggtctttgatttctcggtgctgacaccaggttaacctgctgactagtttatttagatataaggtataaatttgcaagcctatgggaataacctaaataagtcatgtgagtctcatcattcactgttaaggacctttggagaataattcactgtcatgaagcaagacctggtattaaaagccaaagcaaagctttgtgagataaaggcagacttcaaagacaaatataatcataatcccaaaaatataatattctgagaataatcacaaatattttttacctgttaaaataatgaatgattacagctatggaccaacaaagatttctgatgattctactttcctcccctagctctgtgtttaattccttctctaattactttctgagaaatctagatgcttaaaaagaatagataaggagacttttttaaaaaaaaaaaaggaaacatatagggagaaaatcttcagaaaaggagtaacagtttttaacttgaaaattttaaatagaattaaaagtttatgataaattttaagttcaaaaaatatatatagctgtgattcccccaactattttcatgctctcagaaaaatcctagtatacaataatatcattttcatgtaataataatagcatataatatttatactttctatatgccaggcaccaactaagcattttcacatatcagctaactgagttcttaccacattacaaaaaataggttatcatcttttctctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcctcggcctcccaaagtgctgggattacaggcgtgagccaccgcgcccggcctctcttttttttttgagacggagtctcgccctgtcaccaggctggagtgcagtggcacaacctcagctcactacaacctccacctcctgggttcaagagattctcctccctcagcctaccaagtagctgggactacaagcacatgccaccatgcccagttaatttttgtattttcagttagagatggggttttaccatgttgaccaggatggtcttgatcttttgacctcgtgatctgcccgcctcggcctcccaaagtgctgggattacaggcatgagccaccgcgcccaagcaggtatcatcatttttaaatgaggacacaaaggcgcagaatagttaagtttactggccccaagattgtatcaaaagaatagcagtcaagattctcaccatgtataaacccaaaggacaaattcataacaaatatactatttcactacagtaagcatcttaatttcattagaaaacaagttctttaaaaaattattatagatatcgggtctacccaaacattccccacatttagaaattcttgattcctatatgtaattctctttgtcaactaaacctgagaacgtgaaaatatttcagcttgattttaatttattaatactatgacaccaaagaggagactgatatggcttacaaaaaagataaatcaaaatgtttggccagacgtagtagcttacacctgtaatcccagaactttgggaggccgaggcgggtagataacctgagctcaagagtttgaggccagcctcggcagcatggcgaaacctcatctccacaaaaagaatagagaaattacaaaatacaaaaactagccaggcgccatggctggtctcccagctcaagtgatcctcccacctcagccataccagctactcgggaggctgaggtggagggtcccttgagcccgggaggtcaaggctgcagtgatccaagattgcgccactgccctctagcctgggtgacagagcgagactctgtctcaaagaaaaaaaaaaacaaaaaactttatgggtctatgtacttcaacatttgctctgctataaatctgtaacattaaggaagtacctcaactaatgattccacaccaaatctgtttttcagatattaagctaagtagacttagaataaaggatataaagagaagaaataagtctaaaatataatgctagatctagcttcaaagattaggcctaaataattaaactcatgacttcactgaactcgtcattcacaaagacaccaaattcacctcagagcaaagaattaaaggttacagagttaaagcaggcagttccatgttcctacataatttcaaatactcaaagtgtatccacgaaacccatcacagggatgaatgcctgcagctgcctagctctactgcagcctactcccacttgcctcccctaaaatcatccttctgatcaaatagggatttgctgctagtttggttggaagcaatcagaagctacaattaatgaagcattctctcctgataaaagaatgtaaacatttggggagagaaaagatttttaggaaaaacaagcgactgtgcaaagcatttgaaaactgaaatcccaccttcacttggaatatgtctttattaagttagagagctctcaaatatgcctcacacaaatgaggtgataactaattccatttagtctacaacagcaaattacgactctatagggcacaagcaccatttcaacaaggagagttaattatctgttttatatggttcaataagagctttatagtagccaggtcttgatctctcaaaatgactgaaaataaagttagtatacataaatagattaagagttgaaattttatatcatgatttctagacttgggttttcctaaccaatatattttaaaacttggaaactcaaatagagttagcaaatttttatttttccaaatagggacttttatttgtttaaggccatctacaagcaccattaatttatgaaataaaacatttaattcaaaaaatgtagactcaaggataatccttaaattgaaccaatttagttttattttacaaaggactgataagaaacctctttgggccaacactagtccttgagacaagcatttgggaaccaactgtttagaggaacaaatgttagactgagtcaggttccacttatgattctactacttattaactgtgtgaatgcagataaaaactctgaatttcagttttctcatctataaaataagaatatcccacctagctcacaggtctgctgtggaaatcaaaaataaaatgtactgaaatagtgtgaaaaatgtgacaagttgcagaaaaagtcatctagactgtacaacttaccatcagctgactgggtaaacaatgcataatcaggattgactatctcattggacagaatatcaaaccactcacgcacaacaccttgaccctgaattcaagaaataaaattaagcatcaacagaaatatgttatattgggaaatttttttctaaataacaaaatttaaatataaagtttcttcctttatcaactaaatattaaactttattcaaaaggcatttcaatctttctttacatacagtgatttctacatcatcttcttttatacccaccatgccttcttctccatggaaccgtacagcaatcccttgctttagctttgcacaatttgcttttgacacaacttcacagctactcctaaaaatagaatctaaatatgtagcattggttaattttacatattaaaatttataataaaaagcactttgtgcttcacacatatatcagtttctttgttaagcatacctctgtgaaccagcaggatatcattttcattcactggcctgtgcaccatatctgaatctggctgtcctgaatgcaaatgttcatagaaccattcacagcgatctttaaaaggctagctcaaaaaataagagtaaaatatgttagcagtgtatcagtcatctaattatcagatttactagcttgctaaatgccttttctacaaataatcattcttagatctttatttacaataaggagttactggataatgtttgaacatttcaataactatttacaaaaagacagaacttagctgaaatagtttgactacctagagaaatgtatttttttaaattcctacattttcaacacaaaagacttgataaatttggttatgtctcagaacttaatatcagacatgtaattgaatatatttattctcaattcttttaaatccaagccttattacaatgaattttcacacccagaaaaattacgttgcgtgttccatttaatttttcatgaaaataatctcttacacctaatcttatttatttattttggtttattgttgtagttgttgttgtcattttgagacaaagtctcactctgttgtccaggctggagtgcagtggcacgatctctgctcactgcaacctctgcctcctgaattcaagtgattctcctgcctcagcctctcaagtagctgggattgcaggcacgcaccaccacgcctggctaatttttgtatttttagtagagagaggtttcaccatgttagccaggctggtttcgaactcctgacctcaggtgatccacccatctcagcctcccaaagtgctgggattacaggcatgagccactgcgcccggcctcttactcctaactttattcttacttctatcctttagaatacatgcagaaattggaacgtaatttgttatcccttcccattctccaccctaaaaattgaagaataagatctcttgaatagcaaagagagtctctcccttttgttcatctgccaggtaagcaaactgtgagttatctacaatttttgattaatcagaaagtactgagtacttactatgtaccaacactgcatgtaatgtaagagcagtaaaaactccaagaacttgctaaaaactgtttaatagagttaaagagatgtgactaacacagagtaacacaatatatatatatataatatcaatttctcaacaatgaagcatgagctatagaagtcctggtcatggtagcaaagaggaacaatgaagccaatccgagagatactacttctttgaataagcattaaaagtaagagaagaggctgggtatggtggctcatgcctgtaatcccagcactttgggaggccaaggcaggaggatcgcttgagcccaggagtttgagaccagcctgggcaacagtgagaccctgtctctaccaaaaaaaaaaaaatgttttaattagccaagcgtagtggtatgcgcctacagtcctggctgctcagaaggctgaggtgggagaaaactttaacccaggagttcaaggctgcaatgagctataattgtagtgtgctcactttgtcactccagcctgagtgacaaactgagaccttatctctacaaaaaaaaaagtaaggtaagatctctgcaagatagaacttatgaatagaaataacttaaagtggaaaagccctttccccataacctacccccacactcctagaaggtactggtggaaatatgagtaagattttatgtatcgtgagtttaaagatatagtggggtgtaactattagggatttaggaggagatactggacagtgatgcagctgagacactgaaaataaaaacatgaacaaaggtaaagttggagacaggataaggttcaagagatgaaagatacagagaataaataccaagaacaaagaagtttatgatcacaagtcatgactgagaatttgcttagcaaatgatacagacggcaagaaaagtcaaaggagaagcaaggtggtgcaataccatcacaaaagctaagagtttcaagagataaatatgatgaataccatccaacaccacaaaaaggttatcttccaggtggcttttaggacaccaataaatttcttcatctgagctaaattaaataggtttgttttaaaagattcaaatatcacttgttattaattcttaataaaaacaatatgatcgatgagagatgaacttctgccttttaatatttgctttcagtaagaaaagaataaatgctacctttttaaagttaaatgtgtaattttgtccatacttgtaacagtcttccacattttttataaagcactggtgttatatgcattactgtgcatataaattaaatatctcattttcagttaacaagctggaatataaagtacttgaaattctaatgctgactatttctaaaactttggtttaagaggagagaaaaaacattacacagaagcaattatttaagtatgggctttgaagtcagataaacatggtttgaaatcctcactctgtgacttactagacttatcttaaggaaattattaatcctcacagaactttagttttctcatctgtaaaacagagaaaagaatatacctacttcaagagctgttaggattaaataattcaaataaagaacataattatgataattataataatcataataataaattagcaatcatttattaagcacctataagccaggtactttttgaagcactttacaatgcattaccacatacaatcctcacaacactatgagaaaaaggaacttttgtccccattttaccaaagagaaaaatacattaaaagcatttatactaatgctctaatactcaatacctagaatgctcaataaatagatactgttcttattatcattcacagcaatgttaaaattattgtcaataactatttaaaagaaaacttactgcccattataagatattaaactatatcatttatctatgaaatgtgaaccaagaaataaaaacaaatggaaccttttcaagtaattcaagtggaacattaaaaggtacaaactgctaccttcaaaagctcagatcaaacacacacacacacatacaaacacctacacagccaaatggtacatttttgtatgtaaactttctagagtacctgcatttccataaataattcacaaaacaggactgattatagaggctcctcttaatagcatttgtacagcaatacaaaatgtttctccctttaactactggccacctgaaaaccaccaacagaagaagaagtcaatcccttagcagaggtagttgttctttttaactttctagaggaggacaatctccaagttacagaaaacttctaagtacagtagagtacaaagtatttttttttcctctaatgtgagagcaacttgccaatataatgtccagtcccctataaacacttaggcatttatttcctacaaacaagggaattttcctctataactagataacaaccatcaaaatcagaaattaactctgataacactactacatcagatcccatttcaagtcttgccaattttctaataatgtcctcttattgcaaaatgattcatgaactgcctttaattgtcctgtcctgtctccttcactctggtacatttcttcaatgttttcttaattttcataaccttgatagttttaaagactgcaggtctttaaaactgactgcaggtcagttaattttgtagaatgtccctcaactgtatttagtctgatgattcctcctgattagatttaaggtgtgtatccttggcaagaataccacagaagtgatgccatgatgtcctcagagcatcctatcagctggcacactgctatgtctgctttgatcactgctaagcttctctactgtaaggcaccctttttctctttgcaattattctgctgggagataatctgagactgtgtaatcatcctacccttcatcagactttccatttattcattaacttttttcagtacagactcatagattcctgtttatgttgccatcattatttattttgatgctcaaattcttccaaatttggtagtgggagtccattcaagctgtcttccgagtcatgttaacataaccccatcagtctttgaacacttccttactttcttacacaataagatgttgcaggcttattttatactttccctgatctagccctggaattagccatttctccaaggagccctggttcattgagaatggcactgagagaccaagagctgggtgccaggtttgctacatgtatctatgtaaatttaaaactaaattcaaactggtaactccaattcaacacaaggttccttctaatttcctccattttgtaactcctttctccaacaacgagaagttagactctcatacttgcttatttgatcaacctgcaaccccactcccttggtatgtaaccaatctccaatcactgacatggcccctgcatcccactgaggctccatcagacagcactgatcagctgcaaccaccgccaacatggacatcctccttatgccactctaacccacatgactcacactgggaccctcttctacacagacacacttcttaatcacatccaaactccaaaaccccacactaggccaccactacacatgtagacaccctcctcaccctagtcaggcaacaaacacctccctctctgggtcaacaaagtggatacctaatacagatgttttttgactaaattgtccaggaagggaaaaaggaatagaaagtaaaaagcagagacagtattaggttggtgcaaaagtaattgcggtttttgctattttaatttgacaattttaatttggcaattaaaagtaactgccaaaaaccgcaattacttttgcaccaacctatattaaaaacagcagactatctctcaaaaactaaaatcttctttcacctattatctcatttgccccagaacagtatcatacagtgtaggttaagaaattgaacttgtccgggtgtggtggctcatgcccataatcccaacactttgggaggctaaggcaggtggatcacttgagctcaggagttcaaggccagtctgcgcagcatggcaaaatcccgtctctacaaaaaacacaaaaattagccaggtgtggtggtatgcacctgtagtcccagctacttgaaagactgagctgggaggatcgcttcagcccaggaggcagacgttgcagtgagctcagatcaactatactccagcctgagtgacaggtaaaaccctgtgtcaaaaaaaataaataaataaaataaagaaagaaattgaacttgagaaccagacagacttttaaattctggttctcccatttagtagcagaatgacttaaacaagttacttaaccacttcagcttacaaaaaaaagagtagccatcttatacaatggttaagaaaataaaatcattcatggaagcaaatacatagtacctgacctaaaatcagtaaatgtaagtcattattactgccttctctttcacattatcattattaaacagatgtcaaaagatccctctatatagttatgtataattttataaaaattagttcatagcttaacttctgaaaggacaagtgtccctaaagacattaaaaaccacttatcctatttattatcttacaactactaaccaaaccattgcctacagtctgtcctacatatctggcaaattattttctaaaactttgccagaattatgccattctcctaaagcaagggtatcagtggctcctaacagcctagcaaacaaagaaaattcttcaatctggaaatcaaggctcatcattggatgacctcaatctacctttccataactctatcttgctcctatcaacacaaaatttctgctgcaatactgcagttttacatacttttcggtctacatgctccagcccacatggtggctagaaagttctccctctttgtttactcccatcaaaatgttgcatattttttcaagctttctcaaggtaacttaaaatctgcctcctctgaaatttcccctgactacagatgccagagccagctcttcctcccttaaactcctaaagatccaggttatgttgtagttactattttatacatatgtttattatctccccagccagactgaattagaatcctcttagagaagggaagtaagttttctatctccaaaacaactaccatttattgagcatatatcacagtcattcctgacaatttattctggacaatagttctatgaggctgctgtcattatctccattttgtagatgaagaaaccaagggctcaaggatattaggaaacgtgcccaaagttcacatagctggtaaggagcaaaacaagctttcctccagctagcttcatgtaacatgagatgtatggaatgaacaggtacacatctggtaggggaaaggtggtcaggtcaaataagttaggaggattaacaaagctaaatcactatttttactgaagggcttctcaaagccttttaacatgctgccaatgtgatttataaatttccaaagggcatatgttatgtaatttcccaaatgtatttgggggctaaaatccttttcaaaaggacaatcagccttatagaactaaagagtttcattaagctcctttcaggaaatgtggcaatgtgttctgttgtttttgtacagacctctgtacatagtaggcactcagtacatatttcttgaagaaaacttactcctcatattaaagtaacatgcaatcattcctcttacaacagaatgtctgaagtgtaataattattccactaaacagtattagaattttagaaattaatttcattagatagaataaaaagatgaagaaaaatttctacctgtgcttttatgatatgcatgaatcttgacatcaactcaggacattcaaggagaaagtgaaagtggtcaaatataattttgggatttctaaaagaaaaatattttgtttaaatggacaggaagaatgagtagcattaagtgaaatgcaaattcagatacactgacactgaaacagaagaaaaacacataataatccatatctattaaagtttcatttgttattgagcatattttgaatagtacgagaaatagtattttttctgtttagatgaaactgtaagtaaagagaggaaaggctagcagggtactccacaaacccagaaagcttacctattaacaaagcattttaaaacttcatcatgtttgcagacaaattcaatgaaacgaggtgaagtcattctgtggggggaaaacatcaatcagaatacacaggcaaaagtttgtgatataatatagcgaacttgataaatatatactgaactggactggcttctaaaccaaaaaaaaaagaatttggttttgaatcttctttgtaagtttaggaaactgaagtatgcctagccaatttgtaaaatgattctaacttctcatcagcagacgatatcaacaagtgactttttaaaaatcttgaaatttggtgcatttctgctctacacatttcaaatacataattaagagatcctatacaaggtgacattcaccattctacaaagtaataatatatactgcttaatatttaaatattccctactagatctagattagtatgagtatcttaaaacaaggagaaaactttaaatcaacaaattattatttgttgtttttgaaattacaaaagtatcactgcttttcatcatctatcagagaaaaaaaaaataataagccaaaactttcttaccccggaggcatctgacaagaacagcacatgtaaaaagcttgaatgacagcacttagccggttagctgtcatagaaataacatcctgacaatctgcactggcttcctgtctccctgcaagagcatctggtttagattcccttgtgccagtggacagattttcatagctcccaggtcctggaggttcaaatggaggaatggaagcagcatcttgatcttggcctttttgtttcagtaaaatagaagtgatctctgttgagtctcttttgtttttcatcaattctgtggctattaaaactagccattcatctaacgagtgccaaagcaattccagaggctgagagaaacaaaagtgttttttaaacatcattcttaaactacaggattaaaaaaaaaaaaacaaaacacaactagacaaatattatagaagagaaaatttactctagtcatttctatcttcccaagttaacgtgatagtaatgcctaaaggtaagtaataaaattatacaaatgctacataaatgacaatttcttcatttatggcaataatttaatttgtatgtatgtattccttgtaataaaaaggaaaaactaaatctaacaaaaaattcacaatctttcttcttttaattttcaaatgtttagttttaaaagcacacattactactatatataatcacccttaacatttactgtattaatatgatcaatgtcaaccactttcaattaaacaaataagattttttcagttaaaaaatgagaacccctaagtataatcactcaacattttctgtattaatatgatcaatgtcaacaactttcaattaaacaaatgtcttttttcaattaaaaaatgagaatccctaaagaacctaatgaacagcttttttactgtgctcctttcattacatataattcctagaatttggataatttttgacaagaaattacaaaatgtggcatatttatgtatatacatatacttacagacacaatccatttctaataattagtgtttttttaaaacaagagatacaattaccaaacttctattaaaatactgactagcaggccggagatggtggctcacgcctgtaatcccagcactttgggaggccgaggtgggtagatcacttgaggtcaggaattcgagatcagcctggccaacatggtgaattgaaatcccatctctactaaaaatacaaaaaattagccagacatggtggcacacacctataattccagctactcgggaggctgaggcaggacgatcacttgaacccaggaggcagaggttgcagtgagctaagatcacaccactgcactccagcctgggtgacagggcgagactccatctcaaaaaaaaaaaaaaaaatactgagtagcaaattcttaattccaagtaaagattaacacctttctattaaaaaaaaaaaagatgaggagagaataaactatttcctattattattctagctgggtacacaggcatgcacttgtagtcccagttactgaggaggttgaagggggaggattgcttgagtctcggaagtcaaggctacagtgagctgtgatcatgtcactatactccagcctgggtgaaagagtgagatactgtctccaaaaaaaaaaaaaaaacaaacaaacaaacaaaaaaaaaaacctgctaggatatttttaatcccaaataaagattaatagtttataagtggtacagtggttaaacaatcccttcatcctacactattttaaatattcttattgagaatgattagctatccttctgcaaataaatataaaagtttatctcactttttgaatctgacatgattacagaatgctacaaactacaccatgtgctacagaaagactcacctttaaaatatttcaaggaaagaaataatctttcttttaaagaccgccatggaaggagattatacaaccatatttggaaccttagaaaatgtttgaactattctgccaggaaattcttcccaattattatctaacaaataccttcactgccactttcagcctttcttcagatttctgtaatattctctttttgaaaatattttacttactgaatttgcaaataattaaatcacctcaggccttcatttacacgttcaaccaaaaagcagaaaaacacaacaaaaccaacaaaaccaccactactacaatcaacaaaaacctagttcactcactcaaccagtactatgcactaggtagtcgggttaagtacaatgtttccttttttaagagaaattataccctccttcgaagttaaagtaagcatccctctcacccgtaatgagggctcttccatactcacaacggttgacagatttggagtccctgaactgcttaaagaagggcaagaagcacccagctgccataaatactgacagataccttcactgaaaattctaatcatgatccaagttgaaactatagtttctctttatgagcaaaacactgaacctgctgtagaagatgaaaagaacttatgtcagcaaaactatttagctttatatcagaaaatgaacttctgaaatggaaagaacaggtggtgatataaaactgcttgaaacaaaaagaaaaaagaataattggcctctaaatgagaaaagataaaacctagaaaatcaacacactgaaaggaggtaaggcctaacgcaagaaatgacacaggctgatcatgcagatgagcactgagtctaaaccaacagtgatcctattttcaaatattgacaatgtgtaaaaaatgaaagacaaattttcagtggtgcagaaataacaccaaagaaaaaaatggatatgtgtaaaagtgacaacaaagatgtcgaaaagccagagtttttaataaaggaacacagcaaataattagaagaatgagaaaaaaaataagataagtaataaaccacattggacctttctttacttttctctcttttcttaccttttatttcttcaatcatacatacattaaaactaaatcccaaccttgaggtgagtttacctaggaagttttctctttgaagatctattcagaaaattcattcttcaatcacaaaaaagaatactatgaaaataactttaatttctaactatggtagcagccaccaacaaaaaggattcaaataaattttaaaattaaaaataaaccattgcatactatatctgatactttctatattcataaataataaaatacattaaataagaaacaccatacataccatttgttaccgaacaatgagttaattactactgaaaatattagcaggtttcttggtactgtgaaaatactgcttcattcattattattgagtgatccttactgaagaattatattctacatatagtaacaatgatatgccaatcatacatgatttataagcattttaagtcatatttcaaaatatacaatctcgagcttactgaacgattttttaaaatttcaagaagtgctgaaatgaggaatgaatttggcagaaaagtattattaacttaatgttcattcatagtacattgatatcctgttagtctgactattcttaacctaatgtcaaatgccacaacccacaagataagatcttgaagttaaaagtttcacaatctttcttggttaccaaaatttccaaattgtaagtctatgaaaccattaatagtcacagcttactattcacaaaaaaagaacacagcaagactcaggaagcctaaattgtcttccccatgttcactgtgcttcaaaaataaaaatgatcttctccttcaaatgctccaaatttcccaaggcactagataaacatctcttaatgctgaaagaatggctatgtgttaagactaacttgaagaacttctaaaataaatcagaaaactaataacaggatgttaaacaatttcacctactaaaaacacatggcctataaacccactcattcttaatggaaaacccattagttaatttgaacaataaagtagcattagagtaccttgttaatgaaatggaaattagggatcaattgctacctcagacaaaatgtggtaagaattaaaatggtatttccagtctaacatcacagcaactcagtaactagcaaagatttttacttgaaatcacccccacaatgaacaggagatctgattcccatggatgacaatgtacagtttctatttttatccttgtaaatggaagggcagatcattttgccaatccccaaagattccatgtttcattcataaaactgaatgaaaagagactaataaattctttaacagttaatacttattaatgtgtttaaaaactagctgagttttacaattagtgttttacaaaatggaagttcaaaatttaagagaaaataagtgatgagaagaaatagtagttgtcaatgctgtagaaagcagtaccttaaaaaatgaaacaaagataccaacaaaattcttgaaataagaaagtatttatatattatatatatcatagacacatgacaaaacataaagtctgggttctattttttaaacataagctaaaaaggaaaaacagatatccttttctactctattatgtctgtattgactgtgtaggtagaaaactaacatttaaatcaatatttaaatcatttaaatcacctatagagaggctacttaacacatattttctgatattagctaacaggtagcagatcgaaattttaaccaaagaaatcagacaaaattaaatataatctaacccaatttgaataatattgaccacatctatacctgatttgattttatattcatcattactgatgagtagaaagtatgagtcaaagtcaaatcatgggtagattccgtcactaacaaagtgagccacgccagaacacattaaaaacaactttgtgtgatatgaatgtttgaagcagtaaagcttgcttaaaacagccctgacaaaaagagtaggtcaataatgtagatcaaaattttacaaagacagtaagtcgtcactcctaactagagctcaaggaagtggtacgtgaaaagccacatgaattacaagaatgcataacttcattcttccaggaggtggcacaataagaaaaaaaaaaaagaaaacaaaaatacacactcaacgtgcacacacacacatacatatatggctaaaaactgtccttcctagactgatttttttaaagagagtaaaacagatggacagacattcatacataacctttctaaaagactaccatatctattctaagtattaatctactagtgtcaaagttcttgcaaactttatttttacctttttgcaaaaattttccatgtaaggaaagaatcatttagtatagaacactagtttagctttgaattttagagacagcaaagctttcaatcctaactagttttcaaggaagtggcacataaaaacatttatatcacttttttgataaataacctatattttatactcaaaccattgtttaaagaaatgtaagttggctgggtgcagtggctcacgcctgcaatcccagcactttgggaggcagaggcagacagactgcttgagcccaggagttcgagactagcctgggcaacatggcaaagccccatctctaacaaaaaatacaaaaattagccaggtatggtggcatgcacctctagtcccagctactggggaggttgaggtgggagcatcacctgagcccagggaggtagaggctgcagtcaaccatgattgtgccactgcattccagcctaggcaacagagtgaggctccgtttcaaaaaataaatacatgaagaaataaaaaacacaaagttattaaattacacatttttctaaaatctgttactttaaaatgtcacccaaaaaaacattaacaagagcaattatagtcctattcattttgtttacttcataaaattataatttaacatgagtagcaaaactcccttggtttttacatgaatcttccaaggacttcatccatatgtgcttagaaaggcagctgaagcaatacaaaatattttaagaaaatatctcaacaactcttccttgcagttatctcaggaattaactgtcagcaaacccagtaaatgaaagtaccttactttgaaaacacatacagacacacatctaacacacatatcatattaaaatctaaataaaaactgtgcattttatttccttactaataagaaatacatttctttcaaaagcatggtggctgcatattacattaaaaacctataatttaataaaattaattttaaacactaaatatctctacccttagaataaaacaccaatggaataaaaaattttatttgtaagaaaaatacagaaagctcaccaacttgctgttgattagacagagttgagaggagaaaggtgtgcctaattttgaaagtgatatgggtataaaccaaacttacaacctgttcatgagctttctgattaatgaatgcatgctttgtcaaattcatctcttttacgtctatcttcctaacaatgccatatacttttctcaccttgaacacctggcttcttggagttttattcccattgtagcccatatcaattccattactgggggaggatggaccaattcgaaagacgtgacaaaacattctcacaatccttaaaaggctcttcatttgagcatcataattgctagagaggctgaaaataaaaattaaaatatgagattagagtaaaacaaattacatattaaaatacttattttaaaacattttcatcccactgaccatctgtttcatattataatgtaactggagtacaattcctttcctatcatgataggagatagaacagtttaacaggaagttacattatttaacttgcatataaataaattactatttcttaagcacccagaatataaccaatgatcaaagcataaaacatgaagaaaatcactcctttagaatagttggtttcttgtggcaacaacttcaaggcaactcctaaatttttactttcagaagtatatttgtaaattaaatttatactttagaagtctgtatttcacagagaagcaatggtataaatcatcatattcttaggccaacccacaactgttttaacgaagaagctaaactaaactctgccactatatccataatcccatatccccttcccaccacagaatagtaacaaattattcacatatagaacattcacaaattgaaaaatttaaaagttgctatctgcattaggtttgttctctacgtaacgggctgccttatgactatacacaaatataggaaatatttgcctaccatgaaaaaagaaaagactaaaattcaattaacactaaatcatattaaattaacataaactcacttttactgatcagaaagcccttcagaatcccacagttaccttggtattggtcaacatcatgaataccaataattacctttccacagaaaaactgtacgagttaggctaaatttgtattgaatctaataatatatctttaaacacagtatttttgttggttgatggtggttttattttgaaatctctaacatcagttatcttgtatcacaaatgtcggagcaaagcaaagagttgcatgaacttctgcgcagaacagcaggattaactttgtatgttggaggccaaaagggtgaaggtcatgatcaactcagtataccactggaggctatatgagtaaacagccaactgttctcataaatgcaggatgctggcaaactgaaaaactgcatctgccacccagaaggaatgctgagggcagtcacgacccaggcataagtatttcttgtgattaggtacatctgaagcctgttagcaataatatgaagctgtgatcaatcaagcagctgaccaatcatttgctcctcctccctgctctttctacccaataaataccaagggctgcagaagctcaaggttgttgctgcctttgctcattagaagcacggagctctcttcttccccggccccttcctttaaaatagttgcttttgccgggcgtggtggctcacgcctgtaatcccagcactttgggaggccgaggcaggcagatcacgaggtcaggagatcgagaccatcctggctacacagtgaaaccccgtctctactaaaaatacaaaaaattagccgggcgtggtggcaggcccatgtagtcccagctacttgggaggctgaggcaggaggatggcatgaacccgggaggtggagctcgcagtaagccgagatcgcgccactgcactccagcctgggcgatagagcgagactacatctcaaaaaaaaaaaaaaaaaaaattaatttcctaactcaaacccctatcattgtaaaatcctcgcctttggtttatatgggtatattcttattcagtgtcttacttagcatatagctatgatttctctgttcatttccacattgttaactacctttactttcaatcataaatatatagaaaggacgataaaatttcatttcaatataaacatagcattatgtgcaaacgcctcagtaaatgtttattatctttagcaaatattcctgaaatcagttagataataggctacaaatttttccaaaagtgtgctggataacaccttagttgtcactaattaacatatatttgaatcagttattttcttaatgaaaatttctattaaaacaagggtcaacattacttcacataatgggttaagaaacataaaatgattcacaaataaacacaaatgagatactctacaaaaataccattaaacataaatcagcagggggaaacaatttgtatttgaaatcatcttaagaattacctttttacagtacaataaattctaactaataaccaatactcactaccaaccccaacaatgagatatttacaggccaaaaatggccataaaaataagattctataaagcacttggaaggtagcaccataagtggtgagagagcacagtttagcagagtaattttttaaaaactactattgttttggtcatgggttcctttttcctaccctgtttctcctgtcccaccaaccacccctgtcatttttagaagctagattagaacctagaatccgctatttactaatgaggatataaatccaggtttatttattagcttggcaaatcatttaacttcaatttttttacatgtaaaatggagataacatctaaattataaagttactgtaaggtataaatgaaataatatattcgaatgctccttagcttggtacctgcttaataagtgatgaaggtaaacttaaaaacatagatacatcaaaacataaatgctttataattactgtggaagtatatataatatgacaaatatttaagaagaaaaaataagttttctaatgtaggaaaacaggttaaatggtattatagggtacttaaaattataaccatcatcacctctactatatactggacccactgttttgcattttacagaattatcttatttcactctcacaactcataaagatattgccagtttccaacaaaatggaataaaatccaataaaatcctgattagactgtaatttcaacatagagatcttgtctgttttattcatgatcacctcacagatggcctaatggatggtacgccctcaaaaatatgtatttggccaggcgcattggcgcacgcctgtaatcccagcactttgggaggccgagatgagcggattgccagagctcaggagttcaagaccagcctgggcaacatggcaaaaccccatctctactgaaaatacaaaaaattagccgggcgtggtggtgtgtgcctgtaatcccagctacttgggaggctgaggcaggagaattgcttgaacctgggaggtggaggttgcagtgagccaagattgtgctgcctgggtaacagagtgagagcgagactctgtctcaaaaaaaaaaaaataattgtatatatgtgtgtgtgtgtgtgtatacatatatacaatttcttgcaggctaagaaataataagacaataatcatttctcagtggctgcttattcctaattggggtagccagccacatagaaagaagtgtagctacaggaaaacacttcatatataaattcaagtaatataaggcattaactccacgaacttagtgatgataaaaccacaggatcttttagaaataataaagaacttaactgagggggacaggtcagagaaaaaaactttataaggagtcatgaaagtacaatgaaaggttaaacagtagcttgtacctaattttattttattaattagtggtcaagattcctgaactttctcaattcttcttcatgtacatttacttatatgtctaggtaagtaatcatttcacaaaattctagacacatatgcccaaattcactgaagtatgctctatttttagtctctttagagagactaaaatctctttagcaatagttgattaccctggtcctttcaaacaaaacaaaccagaagtcagcaaatttttataacatcgttatcactgacaaaaggtatcccacagaataaactactcaggaggtgaagccaacagacactgctacctattgatttcctcttattgcgaaacacttacctaagcagtttatgaccatttgttgtagcaacttcagcaaggcttgttagaatctttaggtactggctttcactttgctgagacaaatgctccagaacttgccgtaactaaattttttacaaataaaaaaatgtgattacatagtaatccattaaatcttatcaaacaattaagtacctattaagtatcttaaagccaattagtctaaatcaagtcctttagttattttgtcttgcataagtttaaaagctaatatagagatatgatgatacataataaaatctttgttgaaaatcacccagttacaaaacaatagtaaatatagatagaatttaaaaatcaccaagtatagttttggaaatttaattctaaacctctaaaacgaaagagaaatttaaattccgcaatttttctaagactaaaactatcacaaacacatagctgagtaaactagtgattaccaatcataatgatattcctccacagagtcttttcctcttgccatgggaatattattattttatttttatttttatttttttaaagatagagcatcactgtatcgcccaggctagagtgtagtgggcagtgacatgatctcggctcactgcaggctcaacctcctgggctcaatccctcctcccagctcagcctcccaagtagctcagactacagatgcatgccactacacttagctaatttttgtaatttgtttttaagagactgggtctttgttgcccaagctagtctcaaactcctgggctcaagcaatccacccacctcagcctcccaaagtgctggaattacaggcgtgagataccacgcccagcctattctagttatcttaaggagagaccaaagacccagagggcagaagatttatatggccaaatattagcaaaaactatattaattattatctaattcacacttatcctataatgcagataagctaattattaagatatttgtgacaataagcaaaattactaagctaagcacatttgtaaaatgtcatatatgctgagcaggaataaagcttcttcatttacaagctactatcacaaatacaataccatgttttctcggaggtcttcattctgtgtcatttgaataatagtctgaaaaagcctcgggtgatattgaattaatacttcacaagtctctccatatccaccctaaaaacaagatctaaaattatccaggtttaaaaacagtcccttttaaagttcatattcttcacacaataaaaatctttgcacctaccctttcattgaaaaaataataatttttaccattccagtttctattataaagataaggggctcagaatataaatgaaaaacacacctgtacacataaatccagaggagttactccatttttatctggcagatatttggctcctcgtaatagtaggatctgtgctgtatctctctgaccatgactgtgtggaaatagaaacaagttaaaaatacaatctttttaaagtctttctctatgaattatggatagttaatatgagtcaatggaagagtatcacttttaaaaattaagacaagagaatatgaaatacatcttcataatcacaaaaactttctcaatgttaagccatgctttcactacgtagaccagaatgtgacctattaaattttagaactgaatttgtgtcacatttcctaaaataagtcataatattttggggataagtaactactagtcaggcttctgctttttttttttttcttacattcacttcctaatccctctctccaccttaacttgaccatttgcaactttagcctgaccttcttcctaccacacacatccaagtctctaggcttcttaatccaaaagaacctcaagagtcagaacaaaagtacattttatggcacacttgtaatactttgtaaaaaaaaaaaaaattaaaaggaaggaaggagaaaagtaaaaccaatgtaagagaatctggggaaaaagggaacatgaagtggggttattagccaaaaatactatctagctttcgatcttcattttatcaacccactcagtttggcttctgcagataggtattcaatctgccctagaatgaactctcctatccatatgcctcattccctgattgccctccttcttgtagaagtagaattgtgtaactatcactccagggaaattaatgttaacagctgattcttaagaaatgcccagggccaggcatggtggctcacacctgtaatcccagcactttgagaggccggggtaggtggatcacctgaggtcaggagttccagaccagcctggccaacatggtgaaaccctgtctctattaaaaatacaaaattagctgggcatggtagccggtgcctgtaatcccagctacttgggaggctaaggcaggagaatcacttgaacccgggaggcagaagttgcagtgagccaagaatgccccactgcactccagcctgggtaacaagagcaaaaccccgtctcgaaaaaaaaaaaaaagaaagaaagaaagaaaagagaagaaaagaaatgcccaaataagttgtacagtttggaagagcatgaatccaaaaagaactctgtagatgagaaaagcaagtaatctaagcacaggtgaaactagaactcaggtacctgggcttctagacctatactctttccacaataacattacctaaagaggcatgtcatttcacaaagaaaaacactacacagatttctcagaaacttaaaaaacaaaacactattcattctctttcacaaaacggcactgtatgaagaataatttaaaaccaattggaattaaagtttttttaaaaaaaacttaatagtatcctactacgaatctagtgccagaaaactctgcaacgttattataggtctatcactctcttgatactttattattatactgattatcttccttaataccaataagccctaacttaagaataatatctaatttattctagaaaaatcaaaaaataaattagcaatccctttgaaagcaacaataatcagctttaccggcatcaagcaagaagtcctcatcaagcatcacttgtcattaagctcaaagtgttggtcaagatgttataaacaatagctaacagtggttaatgtttcatttacactgttccattctttaacacgcctaaaaatagaggccaagtgaaaagcaactaacttgagcttaatttatttagggatatagtgatacttttgctagtagccaaggttctgaggaatccatcttataaaactgctgagttcaattttaatgatatctcttttacagttctttaatatccatgtgtccaattttttccaattaaattgtaaacttcctgacagtaggcttgttccatagcaccaagcatggcagttgtcttatagcatgtactcaatacattcaatgaattgtattataggctttaatttcagacaccattcatttgacaaataagtattaaagacaacgctgcactctagaaaataacaagagacctgaaacacaatttatttaggatatactaggtaacaagcattatgctcaatcctctgtgcaaagtctgacttaacggtgacactgttataagcattgttaaattaagcaaacaggaggccattagcctgagactgtcactatacttttgagttcctctgtaacaaacttcaacctaacttgggagtatatattttgcaacaaagagcagtttcaatgaatcagacagccaattcttcacaccatgaccaaattaggcaaacacacacataagggtagtcagttgggtgatttctctactttgcttccatattcagcctacaaaagctcattacttacaaattgctgggaagagctctctcacccgcttctgattctgagtgctgcctgattcatgaattgtttttcatttaaataaactttaaatttattttttctaagatttttattttaacagtattcacccaatttttcagatgagaaaaccatggctcaagagtataatggagttgctcgagatgaacagttacatggcagaccagaatttgaatctgcatcagtctgactccaaaatccttcaacaatatcatgctgctctagcaagataaacagagattgccctttatgttttataacctttaaaagtaaacaatttagtctcaagactcccattccaagatggccgaatatgaacagctccggtctgcagctcctagcatgactgacacagaagacgggtgatttctgcatttccaaatgaggtacctggtcgatctcattgggactggttggacagtaggtgcagcccacggagggtgagcacctcacttgggaagctcaaggggtcaggggatttccctttcctagccaagggaagccgtgacagactacctggaaaaacgggacactcctgccaaaatacggcgcttttcccaaggtcttagtaaacgacacaccaggagattccatcccgtgcctggctcagcgggtcccatgcccacagagccttcctcactgctagcgcagcagtctgagatagtcctgccaggctgcatgcagcctggcgggggtaggggcatctgccattactggggcttgagtaggtaaacaaagcgacagggaagctcaaactaggcggagcccactgcagctcagcaaggcctactgcctccatagactccacttctgtgggcagggcatagctgaaaaaaaggcagcagataacttctgcagactgaaatgtcactgtctgacagctcagaagagagcagtggttctcccaccacagcctttgagctctgagaacggacagactgcctcctcaagtgggtccctgacccctgtgtagcctaactaggagacacctcctagtaggggcaacagacacctcatataggcgggtgcccctctgggatgaagcttccagaggaaggaacaggcagcaatatttgctgttctgcagcctctgctggtgatacccaggcaaacagggtctggaatggacctccaggaaactccaacagacctgcagctgagggacctgactgttagaaggaaaactaagaaaggagtagcatcaacatcaacaaaaaggacatccacaacaaaacttaatctgtaggtaaccaacatcaaagaccaaaggtagacaaaaccacaaagatggagagaaaccagagcagaaaagccgaaaattctaaaaaccagagcacctcttctcctccaactgctcacagctccttgccagcaatggaacaaagttggatggagaatgactttgacgagttcacagaagtaggcttcagaaggctggtaataacaacttctccgagctaaaggaggatgttctaacccatcacaaggaagctaaaaaccttgaaaaaaggttagacgaatggctaactggaataaatagtgtagagaagatcttaaatgacctgatggagctgaaaaccatggctagagaacttcataatgcatgcacaagcttcaatagccgattcgatcaagtggaagaaaggatatcagtgattgaagatcaaattaatgacataaagtgaaaagacaagattagagaaaaaaagagcaaaaagaaatgaacaaagcctccaagaaatatgggactatgtgaaaagaccaatctatgtttgattggtgtacctgaaagtgtcagggagaatggaaccaagttggaaaacactctttaggatattatccaggaggacttccccaacctagcaaggcaagccaacattcaaattcaggaaatacagagaacgccacaaagatgctcctcaagaagagcaaccccaagacacataactgtcagatttatcaaggttgaaatgaaggaaaaaatattaagggcagtcagagagaaaggtcagttacccacaaagggaagcccatcagactaacagcggatctctcggcagaaactctacaagccagaagagagtgggggctaatatttgacattcttaaagaaaataattttcaactcagaatttcatatccagccaaactaagcttcacaagtgaaggagaaataaaatcctttacagacatgcaaatgccgagagattttgtcaccaccaggcctgccttacaagagctcctcctgaaggaagcactaaacatggaaaggtaccagccatggcaaaaacatgccaaattgtgaagaccatcaatgctatgaagaaactgcatcaattaacgggcaagataaccagctaacataatgacaggatcaaattcacacataacaatattaaccttaaatgtaaatgggctaaatgccccaattaaaagacagactggtaaactggataaagagtcaagacccatcagtgtgctgtattcaggagacccatctcacctgcagaaacacacataggctcaaaataaagggatagaggaagatctaccaagcaaacgaaaagccaaaaaaaaaaaaaaaaaagcaggggttgcaatccaggtctctgataaaacagacgttagacgaaggaagatcaaaacagacaaggaaggacattacataatggtaaaggaatcaatgcaacaagaagagctaactatcctaaatatatatgcactcaacacaggagcacgcagactcataaagcaagtccttagagacatacaaagagacttagactcccacacaataataatgggagacttaaacaccccactgtcaataatagacagatcaacatgacagaaggctaacaaggatatccaggaattgaactcagctctggaccaagtggacctaatagacatctacagaactctccaccccaaatcaacagaatatacattcttctcagcacgacatcacacttattctaaaattgaccacataattcgaagtaaagcactcctcagcaaatgtaaaagaacagaaatcacaaactgtctctcagagcacagtgcaatcaaactagaactcaggattaacaaactcattcaagactgcacaactacatggaaactgaacaacctgctcctgaatgactattgggtaaataacgaaatgaaggcagaaataaagatgttctttgaaaccaatgagaacaaagacacaacataccagaatctctgggacacatttaaagcagtgtgtagagggaaatttatagcactaaatgcccacaagagaaagcagaaagatctaaaatcgacaccctaacagcacaattaaaagaactagagaagcaagagcaaacacattcaaaagctagcagaaggcaagaaataactaagatcagagcagaactgaaggaaatagagacacaaaaaacccttcaaaaaatcaatgaatccaggagctggttttttgaacacagcaacaaaatggctacactgctagcaagactaataaagaagaagagagagaagaatcaaacagacacaataagaagtgataaagggggtatcaccaccaatcctacagaaatacaaactaccatcagagaatactataaacacctctatgcaaataaactagaaaatccagaagaaacgaataaattggactaaaccaggaagaagttgaatctctgaacacaccaataataggctctgaaattgaggcaataattaatagcctaccaaccaaaaaaagtccaggaacagacggattcacagccgaattctaccagaggtacaaaaaggagctggtaccattcctctgaatggctgataccattccttctgaaactattccaatcaatagaaaaagagggaatcctccctaactcattttatgaggacagcatcatcctgataccaaagcctggcagagacacaacaaaaaaagagaattttagaccaatatccttgatgaacattgatgcaaaaatcctcaataaaataccagaaaaccaaatgcagcagcatatcaaaaagcttatccaccacgatcaagtcggcttcatccctgggatgcaaggctggctcaacatatgcaaatcaataaacgcaatccatcacataaaaagaaccaacggcaaaaaccacatgattatctcaatagatgcagaaaaggccttcgacaaaattcaacagcccttcatgctagaaactctcaataaactaggtattgatggaacgtatctcaaaataataagagctatttatgacaaacccacagccaatatcatactgaatgggcaaaaactggaagcattccctttgaaaaccgacacaagagaaggatgccgtctctcaccactcctattcaatgtagtgttggaagttctagccagggcaatcaggcaagagaaagaaataacagtattcaattaggaaaagaggaagtcaaactgtccctgtttgcagatgacatgattgtatatttagaaaaccacatcgtctcagcccaaaatctccttaagctgataagcaacttcagcaaagtctcaggatacaaaatcaatgggcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaccaaataaaagaggacacaaacaaatggaagaacattctatgctcatggataggaagaatcaatatcgtgaaaatggccatactgcccaaggtaatttacagattcaatgccatccccatcaagcaaccaatgactttcttcacagaattggaaaaaactactttaaagttcatatggaaccaaaaaagtgccctcattgccaagacaatcctaagcaaaaagaacaaagctggcagcatcatgctacctgacttcaaactatactacaaggctacagtaaccaaaacagcatggtactggtaccaagagatatagaccaatggaacagaatagagccctcagaagtaacaccacacatctataaccatctgatctttgacaaacctgacaacaagaaatagggaaaggattccctatttgataaatggtgctgggaaaactggctagccatatgtagaaagctgaaactggatcccttccttacaccttatacaaaaattaattcaggatggattaaaaacttaaatgtaagacctaaagccataaaaaccctagaagaaaacctaggcagtaccattcaagacataggcatgtgtaaagacttcatgactaaaacaccaaatgcaatggcaacaaaagccaaaacagacaaatgggatctaattaaactaaagagcttctgcacagcaaaagaaactaccatcagagtgaacaggcaacctacagaatgggagagaatttttgcaatctactcatctgacaaagggctaatatccagaatctacaatgaattcaaacaaatttacaagaaaaaacaaacaaccccatcaaaattgggcaaaggatatgaacagacacttctcaaaagaagacaattatgcaaccaacagacatgaaaaaatgctcatcgtcactggtcattagagaaatgcaaatcaaaaccacagtgagataccatctcacgccagttagaatggcgatcattaagaagtcaagaaacaacaagtgctggagaggatgtggagaaataggaatgcttttacactgttggtgggagtgtaaattagttcaatcattgtggaagacagtgtggtgattcctccaggatctataactagaaatacatttgacccagccatcccattactgggtatatacccaatggattataaatcatgctactataaagacacatggatacatatgtttattgcagtactattcacaatagcaaagacttgcaaccaacccaaatgtccatccgtgatagactggattaagaaaatgtggcacagatacaccatggaatactatgcagccataaaaaaggaggagttcatgtcctttgcagggacacaaatgaagctggaaaccatcattctcagcaaaccatcccaaggacagaaaactaaacaccgcatgttctcactcataggtgggaattgaacaatgagaacacttggacacagggcagcgaacatcacacaccagggcttgtcgggaagtcagggggctgggggagggatagcattaggagaaacacctaatgtaaatgacgagttgatgggtgcagcaaaccaacatggcacatgtatacctatgtaacaaacccgcacgttgtgcacatgtaccctggaacttaaaagtataataataataaaacaaaaaaaaacaatttagtactcaaaaaaattatggtatcatacacaggaggatatgtgctatgagaacaatggactggggatcagacaggatgaacagacaagatcaccatgtataagcaggacaatgttcaatacacaaggtaaataataaagcctcaaaataactctgtaccatatataacaaaaaaggataatcagcatgaagaaaaagaaatactactataacatttttagaaagctggagtaatttctaaaaccacacagaaatctcatttatgttcagttggcatttcatttcaaaaacagattaagggccaggtgtcgtggctcacatctgtaatctcagcactttgggaggcttagactggagaatcacttgaggccaggcgttgaagacccgcttggatgacataccttgactttattaaaaataaaaattgaaaaattagttcagtatggtggtgcacatctatagtcccagctacttgggaggctgagatgagagaattgcttgacccaaggagttggaggttgcagtgagttatgatcacgccactgcactccagcctgggtggcagaacaagaccctgtctctaaaaactaataatttaaaataagaataattttttaaatagatttaaaaacaataaatagctaataacatacaaaatctgcacaacgcagttaggggctcaagtgcctcacctgtaattcaattacaacgatcctctttcagactgctcagagtgttgcataaaagatttttcagtttaaataactaaaaaaaattactcaacaaataatcattctttataaatgaagttgtttttgagatagtctcaattttttaatattgattgagataatactctcttcaagaaattgccaatgtattttatgaaaactaagaagtcaacaaaaatttaactaataagaaacttgtggtggcttctaaagcacttagacctgatttctcaaacactttcggccccctaactttggactctttcatccttataaatttgagaatttggcataagtataaatagtccagacagttgtaatattattgggaatggcgtatgaaacagatcatattttctaaaggtccgttcctatgctgaaagtttacaattttaagtgtaagaattctttttttttttttttttttcttgagatggagtctcactctgttgcccaggctggagtgcagtggtgcaatctcggctcactgcaacctccgcctttcagattcaagtgattctcctgcctcagcctctggagtagctgagactacaggcgtgcgccacaatgcccagctaatttttgtatttttagtagagacggggtttcaccatgttggccaggatggtctcaatctcttgacctcgtgatccacccgcctcagcctcccaaagtgctgggattacaggtgtgagccactgtgcctggccaagtctaagaactcttttatatggctactttgattttgaatactctaactgaaacgagttgcttcgcagtagctacaaatccatgttctaaatcttagccctttctgtctctagtagagacctctaaaactccattaacatcttactaatttactgtatctatacaactctaactaaaccttgcttttcctaatagaataaaagttatctacaaacagaaaatacctgaaaaccattatacatcccaacctttatttgaagaactcagttgaaggaactgagaacataaggattgaatataaaaccaatctaataatttcaggatttgaaatattggtagaagtcatataaaagacttaaaggtgtgtaaagatggcagggggaaaaaaaaatcaatgtgtgcctatattttacatgacagaaggaatgagttaattagttatatagtttacatgagttataatgtcctgtccagagtatccagagaagaaaactggctggaaaaccctttctatcataattttaggtcaaaatccatctgaaaaagactcacagaaacactacattataaaacagtgcccagggccaggcacggtggctcacgtctgtaatcccagcactttgggaggatgagacagccagatcacctgaggtcgggagttcgagaccagcccaggcaacatggcaaaacgccatctctactaaaatataaaaattagctgggtgtggtggcgcatgcctgtaatgccagctactcgggaggcagaggcaggagaatcgcttgaagccaggaggcagagattgcagtgagccaagatcacgccactgcactccaccctgggcaacagattgaggctctgtctcaaaaattaaaaaaaaaaaaagtgcttagaattagacaagaaacaaaagaaaaccctgtagagcaattaaattaaatgaggacaacacgactttatgctcactgaagagtgaaagaagtatgtcagaacttagtgagcacctatcaactactaagtgttgaatactctgcagcatgctttatagaagccatcacatttaatcttcacaataatctcaccaggcagatatcagcacttccatttcacaaacaaacaaagcttcagggatcaagaattttgactaatgttgtatagctctggtgctgggatttgaacctgcctacacaaactaggttctttcccctgtatcttaataccattctaaatttaattgcaaaattcaaatacaaagaaaacagtttcagtagttgacccttgaatatgatataatatattatatctagtaatacttatcaaccaataaaaactatacattccatttaacctttatcttagagccctataatttgtcctggggttaacttgttctatttcctatattcctttccctttcatttatcagaaataacacattgggaataacttatatttttaatttatacctgtatcaagatatcacaagtaaaattaaaagtgtgcctgcagaagaaccatgttccatatctattattcttctacaacaatgattttttggtttcacatttcatcacagacttgcttaaccatctttgttcaaaaagatctaatatttgctagattaaaactaaatgatgggaatacagtactaggagaaagtatttcttaaaaatccttctgccatatccctaagctcagactaaccatagggatatcccagttctgcacaacactaacatgtctctattttaactattataaatggcattgttttttataagatatttttcatagtgatgcattcattcaaaaacatctactatgcatctaagtgcaaaacactgtactacactttggacataaagtggtaaaataaacactattcttgctttcactgaatttttaggcatgtaggggagacagactataagaaagtaaataaacaactacagaataggaagtgctatgaaggaaatgactgtgatactgcgatcaaaaatctggggaacgacctgcttagattggtcaggaactgccttcctaaaaagttacttaattaagcagtaacatgaataagaaatagccctgtaaaaagcctaaggaagaacatttcaggcaaaacaaataccatgtagaaaagcctgctgaaagagttggttgcatttaaggaacgcaaagagaatcactgtggttcaagtacagtgagctaaacaggagtgaaatcatggaggtctcacaggccaaggtagaacttgaattatatttaaaatgtaacaacgaggcactgaaaagttttatatacaaggcttaaacacaaagtaacaagagcagattcttttttttttttttttttaagatcactttgctgaggaaagaagagattggagggaaacaacataggaatcagggagaccagtgaagagattactgcagtactctaggcaaaaggtaacaacattaaggtggttttggttgagttagaagttcagattccgaacatattctgaaggtagaatttacagaacttactaataaattccaagttcacaaagagagagagagagaaataaaaaataacctaattatttctaatttaaacaactgagacaataaggtttctattgattaagatgaggaaaaactgggggaaaggtttgaggaagaaaatctgaagctgtattttgacatgttaatatgtgagattctgtggtacttctaagtgatgatgttaaacaggcagatggacattcaaatctggaggttcaaaaaaggtctgatctaaagataacccttcaagatacaacatgattacagggaatcaaatgatgatattattcataaattcaggacactatggaaagaactggttttctagccaagcaaccaaatcataaatataatgcaagaaaatggctggaatcagaaagatctggaagtctagaaacccagaagcccctgaattctaatacagggttgttaaatagatgatctgaattggtctcatcaaaggcacatcagagaccccaacaagaagctaaacaagaaaaaaagcaggtctttcaacctaaaaccaacttccaataaaatgatataaaacagaaaaaaagaagaagagaggagctttctggagagctctatatcggaatatgaaggcctaaataaatattacaattcatataatttaaatcaaaaagaagaattactatagtattctataactacatttacataatacataatatgtaggtgtgtatatatttttacatatgtgtgtgggtgtgggtgtgacggcatgtgtataattatactgatagctccttagggaatagagtttatttattactgtattacacacctacaacaatgcatgacacagtgagcgttaactaaacatttgccgaatacatgaataagtgaacaaaatgtacacgtcaagaaaatgaaccaataaagaaatacaaaaataacttaatgtataacaatatctaacaagactgactcaagatttttttttggttatagatacagagaaagaaaagacatggctctggatcaagatatattccaacagcttatcccactggaaatgacctggttacataacacagtaaacgatgggaattaccagattactgatttatcttttgttaataagtacttagtctaaaattgaagtaatcaagcaaatcaaaagctccacatgtaacataaaagcaatggcaattaaatataacagaaaatacttttcctcatacagttaagtaatagaaccataacacttcatcttaaaaaagagattgtacttcctcttaaaagacagcatatttgtgggaaaacaagagagctttagaaaatacacagaaacgtgtgtgtctagaaatagagtattatatacatctggaaatatatatatttctttatttatacatatatatatatatatatatatatatgagcatatatagcatctggaaatataaaatatcatacctgcaagcaaagtacaatggagttgctcctgatacatttggcctgttaatatcagcaccactgtctagcaagcactgcactgtctgagggggaaaaaataattaaaagtaaagccagaggaatcaaacaaaagatacaattaccacaattttaatccatataagggaagttcttcccacaacttgaagctttacataggaactgagtgggcacgtgacaattactatggctgagcaaattcaactttttgtaagctctaagtgtctcaggcacaacacacatatatgtggaattatcagtgtaatagaaactgtgttaatctgggagtctttagagcagcactgtatcaaaagtagtcagtagttacatattggctaccaagtacttgaaatgtggctagtacagctaaggaactaaaattttaattgtatttaattatagctcatttgaatctaaatagccacatgtggctagtgaattggaccctattgctttagatacttgaatttaaattgctttaaataccagaatttttcacctctaaaaaactaagcaccagaataataactttcccaaagtcaagagcataattattaaaatataaaattttaaaaagctaagaagcccttttgctattaacagtagcatatacaggctcaatttcactgattgccattaatatatacttagccccctaagctctactcctctaatcatttgactcatactaagagagagtacgctactataaaatcttaaaaatacatatctgttgattaaggacaggacagggcccagttgaaaacctttaaaaaaaaaaactttcatggttttattcctaaaatcctcatttgagtttttcctgcaaaaaggaagaaaatgtaaaaacataaaacatgaggcaataggtggcttgaggccagtagtttgagaccagtttagtctacatagtgagaccccatttttacaaaaacattaaaaaatgagctagtcatggcagcacatcatagtagtaggcctagctactcaggaggctgaggtgggaggatcatttgagcccaggagttcaaggctactatgaattatattacaccactgcactccagcttgggcaacagagaaagaccccatgccttaaaaaaaaacaaaatagtttgaaattagacgcttattacttctggattgaacacatctgttcatcttttttgccgcttttaaacaaagtacaatgtcagtaaaataataaaactaaacacccaaaggaagaacaagaaagaaaacaacagcatactggataagtcagtaagttttggaaagatagcaagcaaatggagaaatagtaactgacttagcagatcaaagaaagctgaagtctaactgcccacaaatggggattccaacaataagcaactcaattcttactacagaacacacacattaagaaaacaaaaaaggaatagaggaattggaagtaccaggtaccttggaatataggaatggttatgtagagctaaaaataggaggaatagttgaaagtcaatagaagaaacagactctccccctaggacctttcttcccatcctatccagttagttactatccctctttacactgtctcagaagatgggaagtttattctctgcacaaagtgaacagggaggctctggactgggagacaagacacacaggtagagcaaagatgaggagccatcgtgaaaacaacaaattaagtgaaaacctccagcctccatgttccaactaggctcccagaaatccagcaggcaggcttaaaaatctcaagtagaaggaattaaaagcttcctctcaagacttgcatcagaaaagaatcttacagatattggcattagaaagtccccagtgaaacagctcagttcatccagacatggtggctcatgcctgtaattctaagactttggaaaaccaaggtggaaagatcatttaaggccaggagttcaagaccagcctaggcaatttagagagatcccatttccacaacaaaattttaaaattagccatgcatggtgctgcatgcaagacgctatctgtaaagcaagaccctatctctaaaaagaaacaaaaattaaaaataaagaaacagcccaattcgggacaatgggtctatagcagtcatccccaaccaaggttaaattttcccctgggaacatgaggcaacttttttattttcatgaccagggaagggaaaatgctattggcagctagtgggtagaggtcagggatgcagctaaatatcctaaaattcagatgacagcccccacaacaaagaattatcagatccaaaatatcaacagtgttgagaccaagaaacattggtgtacagtcaaaccaagtagtcaacaaactcaactcatgtacacaacgcttccagccaacatttgagtgcctcaccattacacatgaatgaacagacaatattaaaaatacaactgaagcaggcctctaacctgaaaaacaaaaattacaactgaaaaatgaaactcagaataacaaagacagtaaagggaaccaaagaaaacaacaaaaattagaaaagtaactgataacctcgaacagaaaagaaattataccatggaatgataaaaggatgttgggtagaaaatatttaggaaatgagaaatcaaaaatacaatgcaataaataaaaattcaacagaagtttaaaaagaaaatgttcaggaattctacaaagtagaataaaaagacaaagtagaaaataggaaagatgagaaaatttgtgaatcaatcaagggagacatactgcagaaaataagaataaagaaaagaaagggggtgagggaccaaaggggaataaccaagaaataataccaaaaaagttcccagaactgaaagacatcaggtgccaggtttaaaaggctcaacacgtgtctagtctattaaatcaaaagaccttcaacgaggcatgtcaaagtgaaatttcatgataacatcagggataagagattccagagataaacagaaatcatgtgggcattaaaacttctcaacagcaacacagaaatctaaaaggtaaaaagccttcaaaattgtaagataaattatatgcagaattctatagccaactacactattattcaaatagatggttataaataaaaaacatgtttaactattttataagattttttaaattatcttcaatgcaccttttctcaagaagctactgaagcatatcctcctccaaagaaagagaataaaccataatagaagatatggaatctagaatatggagatcaaacatgggagagacactaagattatttctaggtttagagggtgatatgggttggatttgtgtccctgccaaaatctcctgttgaattggaggagggacctggtgagaggtgaccagagcatgggagcagatttcccccttgctgctctcatgagagctcatggtttaaaagtgtgtggcacatcccccctcacgctctttctccctctctcctgccaccatctgaagaagatgcttgcttccccctttgccttccaccatgattgtaagtttcctgaggcctcacagtcatgcttcctgttaagccagcagaactctgagtcaattaaacatcttttcttcacaaattactcagtctcaagtagttctttatatcagtgtgaaaaattgactaatatagaaaatcagtaccaggagtgggacactcctataaagacacttgaaaatgtggaagcgactttggaactgggtaaggggcagaggttggaacagtttggagggctctgaagaagacagtaagatgtgggaaagtttggaacttcccagagacttgttgaatggttttgatcaaactgctgatagtgatatggacaatgacgtccaggctgaggtgatctcagatggagatgaggaacttattggcaactggagtaaagatcactcttgctatgctttagcaaaaagaaactggaagcattttgcccctgccctagagatctgtgaaactttaaacttgaaagagatgaattagggtatctggtggaagaaatttttttttttttttgacacaaagtctcactctgtctcctaggctggagtgtaatggcatgatctcaactcactgcaacctccacctcccaggttccagtgattctcccgcctcccaggtagctgggattataggcgtgcgccaccacacccagctaattttttctgtttttagtagagatggggtctcaccctgttggccaggctggtccttaagtcctgatctcaagtgatccacccaccttggcctcctaaagtgctgggattacaggcctgacccagcacacccagactatggtggaagaaatttctaaccagcaaagcattcaagatgtgacctggcttattctgaaagcattcacttacatgcattcacaaagagatggtttgaaattggaatatgtttaaaagggaaacagagggccaggcacagtggctcacgcctgtaatcccagcactttgggaggctgaggcgggcagatcacctgaggtcaggagtttgagaccagcttggccaatatggtgaatccccatctctactataaatataaaaattagccaggcgtggtggcagggacctgtaattccagctactcggggggctgaggcaggagaattgcttgaacccaggaggcggagattgcagtgagccgagatcactgcattgcactccagcctgggcgacaagagcaaaactacaactcaaaaaaaaaaaaagaggaaacagaacacaaagtttggaaaatgtgcagcctgaccatgcagtagaaaacaaaaacccattttctggggagaaattcaagccagctgcagaagtgtacataagtaacaaggagctgaatgttaataaccaagacaacaggaaaaatgtctccagggcatgtcagagaccttcactgcagccccacatgtcagaggcctggaggcctaggaggggaaaatggcttcacaggccggacccagggccccactgctctgtgcagcttcgggacttagtgctctgtgtcccagatgctccagctccagctccagccatggctaaaaggggcaaaggtacagctcaggccactgctttagagggtgcaagcccaagccttgaagcttccacgtggtgttgggcctgcaggtgtgcagaaggcaagagatgaggttttgaaacctctgcctagatttcagagaatgtatggaaatgcctggctgtccaggaagaagtctgctgcaggagtagagccttcatggagaacctctactagggcagtgcagacaggaaatgtggagttagaaccccatacagggcactgtctagtagagctgtgagaagagggccaccaccccccagacccaacaataggagacccactgacagcttgcatagtgcacctgaaaaagccacacgtactcaatgtcagcctgtggaagcagtctagggggctgtaccctgctgagccacaggggtggagctacccaaggcctcaggatcccaacccatgcatcagtgtgccctggatatgagacacggagtcaacggaaattattttagagctttaagatttaatgacagccctgctaggtttcagacttgcatggggcctgtagcctttgtgttttggccaatttctcccacttggagcattcactcaatgcctgtacccccactgtatcttggaagtaactaacttgtttttgattttacaggctcataggcagaagggacttatctgtctcagatgagactttgaactgtggacttctgagttaatgctgaaattagttaagactggaggactgttgagaagggataattgtattttccaatacgagaagaacatgagatttgggaggggttaggggtggaatgatatggtttggatttgtgtccccgccaaatctcacgtcaaattggaagagaggtctggggggaggtgactggatcataggggcaaatttctcccttgctgctcttgtgatagtgaatgagttctcacaagtcctgtaggtttaaaagtgtgtggcacttcccccttgcacacactctctctctcctgctgccatgtgaagaagctgtctgattccccttaaccttccaccatgattgtaagtttcctgaggccttccagtcatgtttcctgttaagcctgcagaactgtgagtcaattaaaactcttttcttcataaattacccagcctcaggtagttctttatatcaggtaaaatgaattaatatagaggagaaagaaagatggaactgataaactatccaatgaatctgtctttgtagaagagagtaggaagagatattttataggagcatatagatgaagaaacgctgattcatacaaagaaaactgagcaaacccaattattaacttcaagaaaaacagccatcctcaaaaaagaacgttattacagttcactacttgactgagcagtaaacaataccttcttaactatatataaccaatactgtctaatcaaaacttataaatcatcatttaccataacaagaaatgattaaataatatctaaaagtcataaactgagaaagagccatggaagcttgttatttggaaatacatattaaaggaaaagtttagaaagttgaaaattgttgcctctggtgatcatgacttaacaaagaggaagggtggtttaagggactagcattcttatcagaagattttaatactaataaaatatttttaagacatagtattcacatgtctatttaaatttacttctaccccaacatgaattctataatctatgtaataaaaacactgttatataaaactatattataatctatgtaattcctctaaactgaaaacaagtagtcaactatagctttcaaatataagaaaaacaagtatttcagtcactattttataagagaaggactacgtgggccttctaatcatggctttcctctgatcattgacctagaagtggtgtctgtaaggtcccaaaataggaatgagatggaaagtagcaacggtgttcactactgttatagaaattacagaaaataagcctgccaaccaaaaaaagcccaggaccagatgaattcacagctgaattccaccagatatacaaagaaaagctgctaccattcccattcaaactattccaaaaaattgagaagggactattccctaactcattctataaagccagcatcatcctgacaccaaaacctggcagagatacaataaaaaaaaatgtcagaccaatatccttgatgaaattgatgcaaaaatccctaacaaaaacactggcaagcagaatccagcagcacatcaaaaagctcatacaccataatcaagtaggcttcaacctaaggatgcaaggttggttcaacatacacaaatcaataaatgtaattcagcacataagcagaactaaagacaaaaaccacatgattatctcaacagatgcagaaaaggcttttgataaaattcaacatcgatttatgtttaaaaaaaaaaactcttaaaaaactaggtattgaaggaacatacctcaaaataatatgaaccatctatgacaaactcacagccagtatcataatgaatgggcaaaacctgtaagcattaccttgaaaaccaacataagacaaggatgccatctctcaccacccctattcaacacagtattggaggttctggccagggccatcaggcaagagaaaaaaacaaaaggccaaacaaatagcaagaaaagaagtcaaactatccctgtttgcagatgacataacactatatttggaaaataccacagtctcagcccaaaagcttcttaagccaattaacaacctcaacaaagtctcagaatacaaaaccaacgtggaaaaatcactagcattcctatacaccaagagtcaagctgagagccaagtcaagaatgaactcccattcacaactgccacaaaaagaattaaaaacctaggaatacaactaagtagggaggcgaaagatctctacaaggagaactacaaaccactgatcaaagatatcagagatgacacaaacaaatggaaaaacatcccattctcatggacaggaagaatcagtatcaataaaacggctacactaaccaaagcaatttatatagattcaatgctattcctattaaactacaattgatgttcttcacagaactagagaaaactattttaaaattcatatggaaccaaaaaagagcccaaacagacacggcaatcctaagcagaaagaaaagttggaggcatcacgctacccaacttaaaactatactacagggatatagtgagcaaaacagtatggtactggtacaaaaacagacacatagaccaatgaaacagaatctaaaacccacaaataagaccgcactctgacaactatctgatcttccacaaacctgacaaaaacaagcaatggggaaaggattccctattcaataaatggtgttgtaataactggttagctataggaaaacaactgaaacccttccttacaccatatacaaaaattaactcaaaatggattaaagacttaaatgtaaaacccaggccaggtgcagcagctcacgcctgtaatcccagcactttgggaggccaatgctggtggatcactaggtcaagagttcgagaccaccctgaccaacatggcaaaaccccatctctactaaaaatacaaaaattagccgggaatggtggcacatgcctgtaatcccagctactcaggaggctggggcagaaaaatcgcttgaacccgggaggtggagtttgcagtgagccgagattgtgccactgcactccagcctgggcaacagagtgagactccgtctcaaaaaaaaaaaaaaaaaaaagtaaaacccaaaaccataaaaccctggaaaacaatgtaggcaataccattcaggacttaggcacaggcaaagatttcctgacaaagatgctaaaagcaattggaacaagagtaaaaattggaagttgggatctaattaaactaaagagtttctgcatagcgaaaaaaactatcatcagaatgaacagaaaacctacagaacaagagaaaatttttgcaaactatgcatctgacaaaagtctaatatccagcatctataaggaacttaaacaaatttacaaaaaaacaacaaccccattaaaaagtgggcaaaggacatgaacagacacttctcaaaagaagacatataggtggccaacaatcatatgaaagaaaagctcaacatcactgatcattagagaaatgcaaatcaaaaccacaatgagataccatctcacaccagtcagaatggatattattaaaaagtcaaaaaacaacagatgctggcaaggttgcagagaaaaaggaaggcttaaacaccgttggtgggagtaaattatttcagccattgtagaagacagtgtggtgattcctcaaagacctaaagacagaaataccatttgacccagcaatcccattactgggtatatacccaaaagaaatataaatcattctattataaagatacatgcacacatatgttcactgctgcactattcacaatagcaaagacatggaatcaacctaaatgcccatcgatggtagactggataaagaaaatgaggtacatatacaccacggaatactatgcagccataaaaaagaacgtgacaatgtccttttcagggacatgaatggagctgcaggtcattatccttagcaaactaacacaggaacagaaaaccaaataccacacgttctctctaataagtgggagctcagtgatgagaacacatggatacagaggggaacaatatacactgaggcctttcaaaggggtggaggatgggaggagggaaaggatgaggcaaaataactaatgtatactaggctacctatgtgatgaaataatctgtacaacaaagccccgtgacacaagtttacctatgtatcaaacctgtatttgtacccctgaactcaaaataaaagttaaaaaaaaagaaattatagaaaataagtcttcaactctcaactggctcaggagagatgaaagccaatacactgaaaatatatattagcatgcaattaaaacctaacaatccagaaactgtaataaagaaattttaacaaaatatactatttataaaaactatactgttaaaactatgtaatgatataacgtaaataacactaatatgtacccagacagtgtgctaataagcatttatcatttcatttaatgcatctttcgaggaaggtgatattctcttcacttttataagcaggaaattgagtgtcaaagagatcatgtaatttgtaccccaacacataagtaaacattgaagcagggattaaaacccaagtccatgttcataatcactattctatttatcaaaaagtaggcattataattcttctgaattcagattactaaatagtatttatttagtactaacggctaatctgacacatcttcataaactacattaatcacagataatctagtaactccctactaaataactattacagagtcaagcttaagtacctagacagctacttgtgtatggttttaaagtaatgctattttcatgcctgtaaccacagggctttgggagaccaaagtgggaggagtgcttgaggccaggagttcaagaccaatctgggcaacatagtgagaccaccatttctacaaaagaaagtcataattttttttttaaattatccaggcgtgggccgggcgcggtggctcacacctgtaatcccagcactttgggaggctgaggcaggtagatcacaaggtcaggagatcaagaccaggagatcaacacggtgaaaccccgtctctactaaaaaaaaaaaaaaaaaaaatacaaaaaaattatccaggcgtggtggcaggagcctctagtcccagctactcaggaggctgaggcaggagaatggcatgaacccaggaggcagagcttgcagtgagccgcgaccacgccactgcaccccagcctgggaggcagagcaggactccatctcagaaaaaaaaaaaaaaaaaaattagccaggtgtggtggtgtgtgcctgtagccctagctacttgggaggctgaggcagaagaatcacttgagcccaggagttcaaggttacagtgagctatgatcacaccactacgctccggccggttcaacagagtgaaaccctgtctctaaataaaaaataaaaaaagtaggccgagcgcggtggctcacacctgtaatcctagcactttgggaggccgaggcagtcggatcactagaggtcgggagttcaagaccagcctggccaacataatgaaaccccgtctctactaaaaatacaaaaattagcctggcgtggtggtacatgtctgtaatcccagctactcaggaggccgaggcaggagaattgcttggactcaggaggcggaggttgcagtgagcggagatcgcgccactgcactccagcctgtaccgtgtctccaaaaaaaaaagtaatggtattttaaaccatgtattttttatactgcttcgtatttctatttatactgtagcgcttacaatataaaaacaatttattcattagactaacatactcctctactgttctcatcaaactggtgagacaaacttgaagcaaatcatagaaaaaaaacatgatttacaatataaactgtcatagccttgtatttggttggtgaaaaagtaattgtggtttttgctatcacttttaatatatcctacaaagacattaatttttttttaagagagaaaaacacttgattaaaaaatcggaggctgggcacaatggttcacacctgcaatcccagcactctgggaggccaggtggatcacctgaggtcaggagttcaagatcagcctggccaacatggtgaaacactgtctctactaaaaatacaaaaattagttgggcatggcagtgggcacctgtaatcccagctacttcggaggctgacgcaggagaatcgcttgaacctgggaggcagaggttgcagtgagccaagatcatgccactgctccagactgggcaacacagcgagactctgtctcaaaaaaaaaaaaaaattggaaattacttgttccagcattttattttccattcataaatctttctacttttctatttttttaaaaaaaacagcccgatgaagatcctcaaaatatgcaactattaaaagaaacatatttttaaagttttcaatagcgcacttgcagataaaatgttgctccaatcccccaataaaaaccaaaaataaaaaaacagagaaaaacctacttcccttagaattaggataaaaatgtataaaggaattttaaagaataaaaaattgccttgcagcactgaaatgagtgcaaagtcatctatctttgtgaattaaaaaaaaaaaaagatgtttgctggcggttttctttttgtaaaagctctaaaataggaagggaaaggaaaatgcagaattcagtcaattattgattaaatggcctaataagaaaagctgctaggaagtcacagacaacctgaatcacagttttaagaaactctccagtcatttctctgaggacagcaagtaaagataattcaagtacagaagaaaccttaaatgtactcacctcaacaattagcagactgcacagtgatgagtagtaaggataataaggaaggtctacttagtgttaggcgaggggacagaggctgttaacacttatccaacccatcccattactagtctggctgtttctactgagccttgttcggaaggtgagccctcccaagtctcttactactccttaattggacatacagtagtgtgcaaaatggagtctcattctcaaataatccagagtaacaatatttcagtggtaaagcaaaaggtctaaccacaataacaaattattttcttgttgacaatacacacatacgatattgagatatcatgaatgataaatagctatgtagaactataatgatgtatttattgcctggtcttaacaactggaatttaacaacggagtttcaagactccacatacattcttccaaagtgctacaagataatcaatgttttcaactatgtgaaaactgttcatgtgtgcccaaaggttaaaacttagatagatgaaaatgtactctgagcatttattaagttaaaataaatacataaaggctcttgaagaaacaacactacctgagagttttaaattgtatcaaagcatcaaagcataaggcacaacataattcaagagaataaattctggattaaacttttaaaatccctaaggattctcaaaaggagaaattttcagcaatagatacaaacagatacaaccttttgtaagaatcagcactatcaatatacactccacttaaagatacaaaaggaaaaaaagtgacaaacatttagaaatgcaaagaaggccgggcacggtggctcacacctgtaatcccaacacttagggaggccgaggcgggcagatcacgacgtcaggagattgagaccatcctggctaacacggtgaaaccccgtctctactaaaaaaaaaaaaaaatacaaaaaattagccgggcgtggtggcgggcgcctgtagtcccagctacgcgggaggctgaggcaggagaatggagtgaacccgggaggtggagcttgcagtgagctgagatgcgccactgcactccagcctgggggacagagcaagactccgtctcaaaaaaaaaaaaaaaagaaagaaagaaatgcaaagaaaatggcagaatatatggatcaaaatgatcctgcatttgagtggttttgaggcaggagaatagggtctgcagtcagggaacctaaggccacttcaccctgacttcctagaaataaattggaaggaaaaccctaactttccacgcctaagtaacaaaaggaccagcgacctttgcaaacccccacctctttgcgaggcagatgggaaattgaaagtaccactgattggttgtaaaaagcaaccaatcagacgtttgcataggagtctaactctgtaacttcacttcagcctcggattggttgcacacagcaaccaacctctgattggctgcacatagcaaccaatcagactaactgaaggtagttatgtgcaagcaatcggactgagggccaagtcttcaaatgcacagaagtgcaactttgtaacttcactttagcctctgattagttgcttcccacaaccaatcagatgtttgcataggggtgtgacctttgtaacttcagcctctgattgattgcaggccaccacttcatttacatgaggcgaacaccaagtggccaatgggaaacatatatggggtatttagaccccagaagattctgtatccagaaccttgagcagctgctggggccaattcccaccctgtggagtatacttttgttttcaataaatatctgcttttgctgcttcattacttgtttgtgtattttgtccaattctttgttcaaaatgccaagaatctggacaccctccaccagtttcttccatctttcaacaaaaatctatacccattatgtgctatgccctcctctagataatgtgttatgcactactctaaatcaggaaccaggccacacagcaggaggtgagtggcaggcaagtgaacatcactatctgagctctgcctcctgtcggatcagcagcaacatttgattctcataggagcatgaactctgttgtaagctgcccatgaaagggatctaggcacaagttccttgtgagaatctaatgcctgatgatctgaagtggaacagtttcatcccaaaaccatcccctcgatttctgactgtggaaaacttgtcttccatgaaactgggccctagtgccaaaaaggttagagaccactgctctaaattatgtgctatgcacgactctagatactcgagttacaacaatgaacaaaacagacaaaaaaacctgccttcaagaagtttatagtagaaagggaagataaagtgacaagatgtaaataaacaaaatctgtagtgtactagatggtgatcagtgctatccagaaaaataaaccaggattttctatgatttggattcaatttattttagcaaatttcttgcccctaaaatcccacaaatacttctgtgaaaaatgcactgatctataagccatgaagtccaaaaaacctaacaattgtgatttacaatgatggtcataccttctatttttaaaattatatggcttctcatttacttgctaaaattaagcgcagtggcttacaatttactaaatgcaaacacgtaaaagcatgccaacataaataggtgactgataaatgattacctatgtatttttcaagttaatatacataattttaagagctacgctacatttatacataattttaagagctatatgcctaaaactggatcgacaaaacagacttttaaaaaaatttagaattgcaaattccctgcccaattccaccccttctctccccaccaaaaaaaactatctattcccctagtcattgattatctagaatggggttccctcctccttacagaataagaaactattgcggaggaaccgcaaaagaaaagcataggggattttcatatggccttcaagagatccttaagaagaaataacatatttcaacagacttcataacctttcaagtgacaaaacaatatcctgagtggaaaacgaacatacaaacctaatgtgtaggtcaatctcaagtcatttaattgaaggcggtgactaaccaagaccacctgtgcccaatacactgataaattacaaagcaagaaatccaaggcagccctactttatcaatgtcaactctcaaaacactgatcaaagtaaaaaggaatagatattcaatgataaaactctaagtaaaaatcaaagttgtggtattatcactagctaaaaggagaccaaacaacaaaaaaagtgtccttactttttttattaaaaataattctgatgacatgagttatggcaatgcacaaataacttatacactaagtaaaactcccaactcactaatcagtgactggtttacacatgtcttctctaaaaacctgtccaccttcacctattgagaactttgaattcttacatagtatccggcaaaaatcattatcatctggttgtgttataaaagtaacagtggtaagagaactttctactatttgtttcaacttcttagaaatgattaaaggagaattctagcattagaataaatacaattactctgaccctaggaatatactctgaaatgttagtctacctacctttgtgcctcaaggctgaatctaattaatgtctggaaaatgttttcaattaagtttacatggctgtccgtaactggatgaaaaacttggaagctggctaaagataccaagagagctgactgaacatagttgagcactgttccttaacaagtctatgattttagtaaaaaaatgcagtcagttctgtctaatatagtctattatactaagggttcaactatcattttatgttgtttgtgaagctttgtatttagttacataaacttaataaggtttattctgataaaagtgaaatttatttttaaataaattacaaattagtccctaactaatcctgccatgtaatctaacttacagaaatttagactgaactatttgacagttctctacggtttctaaatccacgttattctgagaagactgtaattaacatttttggcaattcaacacatttataaatcttaaagaaaaagttaccaaaaactaggtttaatttatggtccaaaaagcgttaataaattatacctacagagaatagtgttaggttttactcaacttgctaaaactgaaattaaaaaacaacacactgggcccagcttcttgtataagcataaataaataaagggtctagacactgatctgtgtacttttacagaatcacatcacacatattaataacaatcataatagcagtaggtattattgctgttaaatgccttccaaagtgttcacattttccttaattatatcaccagtaaaattatatctccagttgaataaccaaactttgaaatgattttttgaaatcagtatccaaagacataccagaattctggtatgatacagctaagaatggagtttaacagttgatctaagaaaagttatataaaaataaaattattaagaagttgttatgattcctttcatctgatcattattaaatacggatagaagtagtttaaaatcatggtgctattatgctacaatgacaaaaaacagagtgcactcttcaactgcccaaaccacttccttccaagaggaaaatgagacctttatcatgtttacctctaatgcaacagctgcatctatatgaaatcatatttaagattactcaagttcttagttatgacaaaaatgaatcttctgaatcttttatccttaaaaaatgtaatataaatttgaaaaagcacttcttgtcattgaagcaagaatatagcatttagctatatattctacaaagttttagggtgcttagctagttgctcaaaatgttttcatgcactcctcagatttactctaaaatgagattagaaggcgaatttcagaggatttatcatccatgcctctttgaaaagagctcatgtgctttatttcttaatggaattttttccccatttaaagttttctattttattctataaaatatatataatcagaattatgtaagctcctaagcttaaaaataaaatattgaaacttacatgcactggtatatgtctacatggacaccagttctgaacaacaaaaaggccattctgacttgccactgagtcactaggatacctgacaaagcattatacactcagtgttcaacttatggaaagatatacaaatggtttttaataaatcagtaacctttatcctataacatcatatttcatagcccagtaaatcacatgcaactcaagataaaacaatacacttatacactgagatgtgaatgtgtcccagaaatacatgagtaattctgaaacaggcagtattagcacaactatgaacacagatttgtagaactatacttcagccaggaggaaaagaaatagactaatttttcaagattccctcttgtcctaattgaaaaaggaataaagatacatacaatgattcagaaaataatcagtgctaagcattccctttatgtttatatgatcatcataggtaacgatccagaaaataatcagtgctaagcattccctttacctgtatatgatcattgcaggtaactataattgaccaactatgacagaataaatcctgttggccattacataatcaaccacaagtcaacatgactttttgtacccctcctcctctactctgtctgcaaaatctcattctgtgaaactcatcaccacaatgaagtcagactccctataaatcttctgagaatacaattgttcaaaggcatctgactatgaggaattctccattattttaccacacttgctttaggttgtaaaccatatggagtatattatacttataccacctaattttcagtaacttcagaaggcaattctaaatttttaatgcagcctgtaatgcacatgttttgaacaaggttttcttagtaattcttgcttctatactggttcaaagcagctaaaattagcttttataaatctttttctaatctgaatcccagtattttcctatccaagttcctgggcaacaggtagggtgtgcaagtcttagtaaatgacactctgctcacctgttatagcaaagggtgtttatattaaagcaggtgctcttctgtcctctgagagctatcggctagactcattctctaatatgcaatagtgccttaaaaacctgggtcactcaagattaggacatttcacatctttttttcccacatagaatacgttttaaatttaataatattgactctaagtaaaaactaatgagaagaatatacttgaaaacactgcattggttttcagatgataaaagacaaaaaatgcaaatgaacaatggtgtccagaaaaaattccaggaaacagaaaaaggatcctataaccctccatttttccaacaccatattaaacataagacaatgtcacctttgcctactatcttgaagaagtccaatattctgtgaattgtgatcatacatcctgaaaccaggttaaggaaaaagtgtttgaagagataaaaatccagattccactaggaattctcccttctcccaacaagagataagactcagaaagtttgtaaccaaaaaaataaacaaactttgtatccttgtagttaatggtactgactttgagttggttttgttgttgttattatggtcagcaagaaaataaattacattctttttttttttttttttgaagagacgaggtgcagtggtaattcactagcatgatcccacaaacagaccagcatgggggttgtgacttgctgtttctgacctgttctggttcacctctccttaagctatctggcatcctgagaggtcaccatattcatgccaaacttagtgtggacatccaagcagcatagtgcactacaacccacaactcctgggcaaagggatctctccacctaatcttgacctctccacctcagcctcccaaacagctgagactactggcacacacctgtacattctattaccaataatgttaaatgttaaaaaaagaaaaaacttaaaaacataaacaaggtagaaaattacagcaaagcagaaattcaatctaaaatcttaagccctccatctttatataaggcagtaaagtctcttaatgagagagaaatagcaatttcaaaagccaaatgtctggacacaggaataacaggaaagcattgtcataaaacaaatgcatgattttagaaacctagagtaagaaagaaaatagccaggcacggtggctcacacctgtaatcccagcactttgggaggctgaggcaggcagatcacttgagaccaggaattcaagatcagcctggccaccatggcaaaaccccatctctactaaaaatacaaaaagtagctgggtgtggtggcacacacctgtaatcccagctacttaggaggctgaggcacaaggatcacttaaacctgggaggcagaggttgcagtaagctgagattatgccactgcactccagcctgggtgacagagcgagcctccgtctcaaaaaaaaaaagaaaagaaaagaaagaggccgggcacggtggctcacgcctgtaatcccagcattttaggaggccgaggcaggcggatcatgaggtcgggagattgagaccatcctggctaacgcagtgaaaccccatctctactaaaaatacaaaaaattagccgggcgtggtggccggtccctgtagtcccagccactcgggaggctgaggcaggagaatggcatgaacccgggaggcggagcttgcagtgagccgagatggcgccactgcactccagcctggggaacagagtgagactccatcaaaaaaaagagagagaaagaaaagagaaagaagagaagagaagagaagagaagagaagagaagagaagagaagagaagagaagagaagagaggaaggaaggaaggaaggaaggaaggaaggaaggaaggaaggaaggaaggagaaagaaaagaaaaagaaagaaaagaaagaactgttacttgtaccatacacaatgcaagtagaaaaataggataacctgactcatactattaaccagtgtcattgctcactttcctcactatctaatctccaaaattgaggcttaacagcaaaagataaaataaaatatgaagttttatttgctaaaactgagaacagaatgaacattataaatgttaaaattaaatgtgaatatactacatttaaaaatttagtatgtttggctattaaaacctatgaattagaaataaaatcaaaatgcaaattacaaatattttgaacagatataaaagcactattttcctgttttttgttgttgttgttgttgttgttgttgtttgatacaggctctcactctgtcacccaggctggagtatagtggcacaatctcagctcactgcaaccgctgactgctgagctcaagcaattctcccacttcagcctccggaacagctgggactacggatgcatgccaccatacccagctaaatttttttgtatttttagtagagatggggtttcgccatgttgcccaggctgaactcctgagctcaagagatccacccatctcagcctcccaaagtgctgggattacagctgtgagccacggctcccagcccaaaagcactattttctatttcttctaaccatacagaatatatttatcagaagtccatatgggccaggtgcagtggttcacgcatgtaatcccagctactcgtgaggctgaggtggaaggatcatttgagcccaggagtgtaaggctgcagtgagctaggatcccaccactgcactccagcctgggcaacaaagtgaggccctgtctcaaaaaaaaaagtccatatgatgcagaaaataagattttgctataatgcttcatgttcccaaatatgcacaatgaaaaacttttcatgaaatcaattttaaaaaacaaacacatgcagcttaaagtcctcatggctcaacttaccgtcttgtgaccgttctggcaggcaacatgcagtgctgtctgccccatggcatcctcaacatcaacatcactgacatgctgcacaaggtcatggagtagttctgtccgcccattcacagccagccaatgtatctgtgaagccatttagttacttaacatttgtgtaatagtgttttatataaaaacagcagataaataatgttatttctcagctgggcgtgatttgcacatgcaaatctaaaggtgttttaagtccatgtaatggtttaaaactaaaggtattttaagtccatgtcatttttttccttttttaaatttgtttaagttttatttacaggtttgggggttttttagagttggggtcttgctatgttgttcaggttggactcaaactcctgggctcaagtgatcctcttgcctcagcctcctaaatagctgaaattaggttttatatgaggaaaacttcggtatcaagatgcagattacattaccacagatttcaaaatcaagaactcagtggggctccaagtggtgactcacgtttgtaatcccagcactttgggaagttgaggcaagaggattgcttgaagcaacgagttcaagatcagcctgggcaatgtagcaagaacctgtctctacaaaaaattcaaaaattagctgggcagccgggcacggtagctcaagcctctaatcccggaactttgggaggctgaggcaggcggatcacaaggtcaggagatcaagaccatcttggccgacatggtgaaaccttgtctctactaaaatacaaaaaattagctggacgtggtggtgcgtgcctgtaatcccagctacttgggaggctgaggcaggggaatcacttgaacccaggaggcggcagttgcggtgagctgagatcgtgccactgcactccagcctgtcaacacagtaagactccgtctcaaaaaaaaaaattagctggccatggtggcatacacctatggtcctagcttctcaggatgctaaggtgggaggatcccttgagcccaggagtttgaggctataatgagctatgatggtgacactgcactcctcctacctgtgtgacagaatgacaacctatttccaaaaaaaaaaaaatcgttttaaaataactcataatggttcaaaacagtaagtatactaagctcccaatcatcaaatactctgcttctcagataatcctggactctatgcatagtttgtctctggagaaaaggtgttagatatttttcttttcccagaagcaaacataagttaaaaagtaattaacatagcaatgctatattccttacttcctgtattttacaagtaacacatgtatcttacataaataaaggagggtaaaaaatatataaaacacctataagtctaccactcaaagataatcaatgttaaaactctggactatgctatccattaatttttcacatgattttttttcattaaaaagaaaatcatgaaatccctgttttaaaatggcaggtttaatccatgcatcagtctctacttcttccctaaaccccacggaaatgagagtaaagagtatttccttaaaagactagatccataaagatacagaggagagaacagcaagttttggaagcaaagaaagtagatgatgctttttatcttgtcagattatacttgttgacttgtcagaatgctacaccagtattagagaaaccccccaaaaaatgtgattcagatcacaggactcccaaaaggctcaagaatcaatagtaagtaccatgcacctcttgaaaagaggttgaaagtttatttaataagatttagagcctcatatctctacccctccccaactgtgcaaggccagtaatggcccccactcaaccagatagaatgcaagaggcttgaaaacagtctctagataagagacaacaggcacattgaacaaagaataccacactaaaaaggggagattaagtgcaagtttaaatattgaatattgattttacaaagcattcttctctatccagcacgcagactgttaacatcttccgggcagttggaagagtcttctctgaggaatatgaccagttcaagagtaaatgcctaaagaaatcgacactggaaaggtctaagaggcaaatgtccaaggagatcatcctacactgaagcctctagtgaacaaagcctcactcatgctgacagccttcaaatagctttttccatttccaccaaacatctgataaacgcatctaatttgaaagacaaactacaaatttttttaaagcaaaaagtagggggaaaaaggaaccatgaatattcaagaaaaaactatatttaatactgtcagagggagaacatactgattgcatccctgaaatgagaaaaggatactattttttgaaagagacaaggaaaaaaaactcttggaaattaatactatgatagagacgtgcaaactcaaaacaagaattaggagataatattgaggaagtctccctaaaagtacaaagaaaagaaatgagaaaaagtaggaaaattaaagggctagtgtgaataggtctaacatttaaataataggagttggggaaaaaataaaacagagaaaagacagaaaaagaaatcatgaaagtaataatttatgaatatttctcataagttcctattacatgagtttccaggttgatagggtctcaatattatccatcgaaatggataaaataaatccaaagcaagacataataatcacaggattttagaacactaaggacaaagtagattctataagtttctagagagaaaaatcaaaacaggtttcatataaagaatcaagaatccaaatagcactaaacttcaaaacaaagctagaacacaacaaagcaatgctttcaaaattctaaggaaaaatgatgtcttgtctagattgtcagctaaactgtcaattacataatcagactcaaagactcaagtcatatcaaacatgcaaggtggcaacacatctcccatgcacactctcaggaaactctcagggttgtgctccatcagagtgacagaatagttatcagaaaagatggatatgagacccatataacaagagaacccaaagcaagaaaaaagcaaaaggaatccccagatgatgagacattccaaacaactgtgcagcagacctaggtatcaaccaatccagccaagagagcacagaagtctccgtaagagactccttcaagacataatcaagcacatgaaaggtactgaatacatattaagaggatatttacaaagctgagagagaccttggaattgaattagtaaaaagttataagaaaactttaaagtaataaagttgcagtagggcaagaaacaaatacaaaagacatacaaactgcgaagaaagaaataaaggcctggcgcggtggctcacacctgtaatcccagcattttgggaggccgaggcgggtgaatcaccggaggtcaggagttcaagaccagcctggccaacaaggtgtaaccccgtctctattaaaaatacaaaaatcagctgggcatggtggcacacacctgtaatcccagctactagggtggctaaggcaggagaattgcttgaatccaggaggcagaggttgcagtgagctgagattgcgccactgcactgtagcctgggtgacagagtgagactctgtctaaataaataaataaacaaattactgtctctacgtgcagacaacatgactgtctatgtagaaaatctcaagcaatttgcccaaagtcccccagaactaataagtgagttcagcaagattgcaaaaccaaaaaccaattgcatttccatctgaacatgcataaactcaaattaaaaacacaaggccatttataattatgccaaagaaaatgaaacagttatatgcttaccaaaacatgcacaaaatccccactgtgctgtacaaaattctaatgaataaaatcaaagacctaagtaagtgtggagatatactgtgtttatggattaaaagactcaatcaacacagtaaagataacaattctccccaaattgacctatcagtttaaagcaactccaatcaaaatcccagcaaggtttttttgtagacacagacaagtttattctaaaatttatatggaaaggcaaaggaatcagaatggctaacacaatcttgacaaagtgagaggaattattctacctggtattaagacttacagctacagtaatcgagacagtgtggtattagcagagagattagcagagacacacagatcagtggaatgaatataaagtccacaagtgggtccacacaaatatgcccaactgatttttgaaacagatgcaaaagcaaattcatgtaggaaggacagccttttcaacaaacagtgctagtactggacattcataggcagaaaaaaaagagtaaaccttgacctaagcctcataacttatgcaaacagtaactcaaaagagatcatagacttaaatgtaaaacacagaaacataaaacttgtagaaaaaaatatatgagacaatcttcaggagtgagtgctaggcaaagagttcttgataccaaaagcatgatccataatgcaaaaaactgatcaatttgacttcaaagttaaaaaacttttgctcttcaaaagaccctcttaacaccactattagaaacagtactggaagacctagctagagcaatcaggcaaaagaaagaaataacggacattcatattagaaagaaagatgtcaaattattcttgtctgcagatgatatgatcttgtatttggaaaaacttagactccaccaaaaaactgttagaactggtaaataagtacgttgcaaaatatgaaatcaacatgcaaaaatcagtagcattctgatgtcagcagcaaacaacctgaaaaagaagtaaagaaagtaatcccatttatgacagctacaaataaaataaaatacctaggaatcaacttaaccaaagaagtgaaagatgtctaaaagaaaactatagaaaaagatgcaagaaactgaagaagacacacacacaaaatggaaaaatattcctaagggttggaagaatcaatactgtcaaaatgtccatactactcaaagcaatctatagattcaatgtaatctctatcaaaataccaatgacattcttcacagaaacagaaaagataattctaaaatttatatggaatcacaaaagatctagaatagcaaaagccatcctgagtaaaaagatcaaaactggaggaatatcattacctgacttcaaatcatactacagagctatagtaaccaaaacagcatgttactggtataaaaacagacacacagaccaatgggacagaacagagaacccagaaataaatccacacatctacagtgaactcattttctacaaaggtgccaagaacacacattggaggtagggaccatctcttcaataaatggtgcgggaaaactggatatccatacacaaaaaatgaaactaggctcctatatctcttgccatatacaaaaatcaaacaaaaattaattaaaaacttaaatctaagacatgaaactactaaaataaaacactggggaaactctccaggacattggtttgggcaaagctttcttgagtaataccccttgagcaaatttcttgagtaaatttgcttttaagtaaaagcaaaagtaaccaaagcaaaaacggacaaataggatcacttcaagttaaaacacttttgcacaggaaaggaaaaaatcaacaaagtaaagaaacaacccatagaatgggagaaaataactgcaaactatccatctgacaagggattaataaccagaatatataaggaactcaaacaactccatagtaaaaaaaaaaaaaaaaaaaaaaaaaattttgattaaaaaaagaatgaaagatctgagtagacacttctcaaaagtagacatacaactggaaaacaggtatataaaaaggtgctcaacatcactgatcatcaaagaaatgcaaaccaaaactacaatgaggtatcatctcacccctattaaaatggcttatatccaaaagacaagcaataagaaatgctggcaaggatgtcaagaaacaggaactatcatatgttgttggtgggaatgtgaattagtatagccactacggaaaacaactgcattcctggacatttatcccaatgtgtaccctgctgtttttaacagctttactcataatagcctcaaaccagaagtgaaccaaatgtcttttaacaggtgaacagtccaacaaatggtggtatatccactactggatggaatactattcagcattataaaggaacaaactattgataagtataacctagataagtctccaaggaatgtgacaaacaaaaaaagccaatccccaaaggttccatacaatatagttctatctctgtaacattcttgaaatgactaatggagaacaaattaatggttgctataggttagccatgggatgtgaaggacaaagggaaaggtatggttataaaagggcaacatgacatatctctgtggtgttagaaatgttcagaatattgactatggtggtgaaaacctaccatgtacacaggtaataaaactacacaggtaacctacacaagtaataaaaatgaatagaacttaaaatacataaacatacacacacacatacaattaaaactgaggaaggccaggcatggtggctcacacctgtaatcccagcattttggaaggccaaggcgggtagatcacctgaggtcaggagctcaagaccagcctggccaacatcgtgaaaccccatctctactaaaaatgcaaaaattagctgggcatggtgacgcacacctgtggtcccagctactcgggagactgaggcaggagaattgcttgaacccaggaggcggaggttgcagtgagctgagattgcactactgcactctagcctgggcaacagagcgagactctgtctcaaaaaaataaaataaaataaaactgaggaaatctcagtaagacagattgtatcaatgtccatgtccttactgtaatattatagtatagttttgcaaaatgttaccactggaggaaactcggcaaaaagtgcagggcaactctctctctctattatttcttagcactgcatgtgaatctacaattatcttaatttctaaaaaaagacaatcattaactacagggaaaataaaatgttatgcaagaaaggaaagcaactataaccaactatttggcttaactatgaatagttttcgtgtactcaaaaaaataataacacacaaaaatgatctaactaaaattacaataattgtattggagggatacaaggctaatgtgcttatacaccacagggcgggaggaggggctgaaaaagagaacaatagcctcatcttccagaaagtcaacaggtgatacctaaaaccaaaaaaccaggaagtagcatttagcatgctatttagatatagagacaacattttaaaatccattaaaatagctgagagaggcccgtcgcggtggctcacacctgtaatccgagcactttgggtagccaaggcgggtggatcacctgaggtcaggagttcgagatcagcctagctaacctggtaaaaccccgtctctattaaaaatacaaaaaaaggctgggcgcggtggctcacacctgtaatcccagcactttgggaggccaaggcgggcagatcacctgaggtcaggagttcaagaccagcctgaccaacatggagaaaccccgtctctactaaaaatacaaaattagctgggcgtggtggcacatgcctgaaatcccagctactcaggaggctgaagcaggagaattgcttgaacccggtaagtggagggtgcagtgagccaagacagcaccattgcactccagcctgggcaacaagagtgaaactctgtctcaaaaaatattagctgggcatggtagcaggcgcctatattcccagctactcgggaggctgaggcaggagaatcacttgaacccgggaggtggaagttgcagtgagctgggattgcgccattgcactccagcctgggcaacagtgagactctgtctcaaaaaaaaaaaaaaaaatagctgagagaagttgtttagggagtgggaagtttggaggttggggaggaaggccaagagactgttttctacaagccaggtagaatatttgattctttaaatacatacatgaataattttgttaaataaaaattttatttttacaaattttctattccacctcccttaaagtacaggaaggaagggaagaaattaacagaaaacatcttatgcaattaaaacagattatattaacattcaaccatcatgcctaaactggttagtgtcctaaggaaagatctatgtcatttctagggtttcataaccctctgttgcacgtaccgtgtcactaagcatcctacggatattcagaatacagtctttccttacagaataggtggtattatattattaatacataacaaaatctgaatttttacaggaattgtagattccatataataatcatgattgagtttattctataataagccattcaaaattttaggaaagttgtttttctatacctcattccccaatttttaatcataaaggccttgaaaaccagcatggtaagtaaatattcaatattattctttattcaaaaattaaaagattcaaaatataaatactatcaaaggaatgtataatttaataaataaaacttaacattttctgccatgatttcaaaacaactactcaacagtaacataattctatgttatctctacttctaaaattaataatgctccattaaataatgacaatttggttaaaactttgggatttcaacaatctcttcagcaatatcccataccacctccatgtgattcaaaaatacataaacttatttttgcaaagaaagtggtatggcaaaatggccaatactactttatataaaatataagtctaataacaggacaaaatgttaacagtaattttatctttgggatgcagaagtgaaaggattgcttgaggccaagagttcaagactagcctgggcatcaaagcaggaccccacctctacaaaaaaatataaaatatactagccaagggtagtgagacacacctatagtcccagctacttggaaggatgatgctggatgatttcttgagcccaagagtttgaggttgcagtgagctatgatcatgccactacactgcagcctgggtgacagtgagaccctgtctctaaaaaaaggttttattggccgggcacagcagctcacacctgtaatcctagcactttgggaggccggcgggtggatcacctgaggtcaggagttcaagaccagcctggccaacgtggtgaaaccccgtctctactgaaaatacaaaagttttttttttttttaaccgtgattatctcagagtgcaaggaatacagggagtgctcattccctctgttaccttttttattcctttctgactagctatctaattctacaatgaacatattaaaagtatttaaaagaacataacgaaaaacagctctccaagaatgaacacataacacacctcagcagagatgctcctaggaagtcccttaaaagtcagtgacaaaggctaggggaataagcttcaaaataaacaaaagtcataaacttaaaaaggagaagagagaaatatggtaagccataacttatcttaatatagcttaaaactttatctcaaatcattctacaccttcttaatccctataaagaagtaacacaggccaggtgcggtggctcacgcctataatcccagcactttgggaggctgagacaggtgaatcacttgaggccagaagttagaaaccagcctggccaacatggtgaaaccccacctctactaaaaacataaaaattatctggacatggtggcgcatacctgtaatcccagatacttgggtggctgaggcacaagaatcgcttgaaccaggaggcagagattgcagtgagcacagattagaccacctcactctagcctgagtgacagagcgagactctgtctcaaaaaaaagtaacttgcagaaacacttgtactacactttgcctaactgtcacattcaatatcattttctaaaacatacttttaaaacatcagatgaaattgatagcacttactgctgtaaggccttcattattacaaatgttgacatcagcgctatattctaataatttactcatacatttcttctgcctgaaaagaaaaaagagtcatggataactggtacttaaaaaatatatgcaaatgacaattaatttactgaaatattagcaacaatcaataacagctgatgacatcataacatctttatctgtaatatcaagccatatctgcaatatttaaacaaacactacttgacgcaagatacaaaactgcttctatgactcaaagataacaggataaaacaatgacacagtcaggttttcatatcattgggacaaatcacattcaaactgtagagaagtttctagtattgactaagttcatgaaatagtaatattcattagaaatataacaaaatacaagtctaatggaaggggaatggatagagaaaaatgatgtctcaacattgtatcctacattcttgacagcaaaacatttaaaacataacactaagatgttacaaaaccatactcagaatatcaataaaatgcatgtctatgcatccctctactcactggagggtgaggagggggatgtagagattcttttttttttaagttatttgtattgtggtaaaatacatataaaatttgccatcataacttttttttttttttgagacagagtcttgccaggctggaatgcagtggcacgcttggttcactacaacatctgcctcccgggttcaagtgattctcctgcctcagccttccgagtagctgggactacaggcgtgtgccaccacgccagctaatttttgtatgggtttttttttttttttctgtgatggagctgtgctcttgttgcccaggctggagtgcagtggcggatctttgctcactcactgcaacctccgcctcccaggttcaagtgattctcttgcctcagcctcccaagcagctaggatttcaggcgcatgccaccatgcccagctaattttgtatttttagtagaaacggggtttcaccatgttggccaggatggtcttgatctcttgacctcgtgatctgcccgcctaggtctcccaaagtgcagggattacaggcgtgagtcaccacggtggcccatcataaacatttttttttttttttgagacggagtttcactctttgttgcccaggctggagtgcagtgatgcgatctcggctcactgcaacctccgcctcccaggttcaagcaattcttctgtctcagcctctcgagtagctgggattacagacatgcaccaccacgccaggctaatttttgtgtattttagtaaagacacggtttcaccatgttggacaggctggtcttgaactcctgacatcaggtgatccacccccacccccccaagcctcccaaagtgctgggattacaggcgtgagccactgcacccagcctccatcacaacctttttttttttttttttgagacagagtttcacttttgttgcccaggctggagtgcaatggcacaatttaggctcactgcaacctctgcctcctgggttcaagcaattctcctgccttagcctcccaagtagctgggattacaggcgcccgccaccatgcccagctaatttttcgtatttttagtagagactgggtttcaccacgttggccaggctcatcttgaactcctgatctcaggcaatccgcctgcctcagcctccctaagtgctgggattacaggcgtgagccaccacacccggcccccatcacaaccatttttaagtgtatagttcactggtaaatagtccagtgagtaaacagtaatacatacaatacagtgtgtatatgttaaatacatatgtattgtatacatattatataataaatatagtagtaatgtaatatgaggttggtgcaaaagtaatggtggtttttgccattactttgaatggcagagtatatactatacatgaatatattactatttattcaactagatcataaatatcttcataccatggattatatcatatttctttaatcaactcagtagtaagcatagccaggctcatagtagctctcaataaaactttgattattaatattcaatcttgtaagtcaatagctaaaattctcattgattgaataaaactttttagaaaaaaacaactgacaagttacttttcttgctttttgtacttgtaatgaagttaaatatcacttaaaattagcattataatcaaagaaactgaagaaaataaagctctgggtaaacttttttttttttttttttgagacaagagtctcactctgtcgcccaggctggagtacagtggcacgatctcggctcactgcaagctcctcctcccaggttcacgccattctcctgcctcagcctcctgagtagctgggactacaggcacccgccaccatgcctggctaattttctgtatttttagtagagaaggggtttcaccgtgttagccaggatggtctcgatctcctaacctcataatctgcccacctcggcctcccaaagtgctgggattacaggcttaagccaccacacccagccaactctgggtaaacttttaagataaaacatttacaaagttcctttatctaacacactgttaggaaaaccttaagaaataaatattcaataatcatgagaccacaaaccagatagtcccattaaaataaatacattgtttaaatgtgtgatcgtgtgtctatacctatatgggtggatttctaaaacctttcagaagcctattatggaccactggcctaagccaataatggcaaaataaatcattaggtaggaatgagccagggaaataggcccaaaaaagtgtttatggtaggggttgttgaagaaaagcagtaatctataatgcttccccttccaaaaatgaattgcaaaaggtacagggaatgtaggagagaaatatatcctatctttctattgaacaaccattattactattttccagggtctgaataagtcaaatcaacccaataaataagtagctattttgctaacagaactaaaatattatgtaacacatgggccctaccctttatgagctcataatcacctaaaaaataaagaaaaactcttctttcaaaactgaccaaaacacaacctaagaacacacaataattttaaagcctctccttttaacattctcatataagcatgagcaatgctgaatccccctgtacaaggaagcaactatattcctgctcagatattgcaccaattatagggagcttatggcaacccaaattacacagggaccagtcacccaagtgctctgtggaagcttaatggggcttcttttggaaaggaggacaatccaatacagcactaatggcaaagagaaaaatgctaaagcaagccaagagaaatatagcagccatctgatgacagctgagggaacaaaacaaaaagctggccccaaaacgcagactgaccaacaaaatgggaagaactctactatgacttctacttcagtgtggataaatgtgaactcataaagaaattacagtaaaaagctatttctgaaaacatcagccactacaggaagtactcaagtcacttagcaaacattgagcacctctaagttgtacaaggcttccactcaataaataataaaaaccaaaatatttaagtattgaatatcaagagtaatctttatagaaacagaaaggcatccaaattaaagagagggtcatgaattctttttattccttttcttcttgctgaatagctatgtgaatcatgtaatatctgccatatttcttcacctttaaaatgtaatggtcttcaatcactgttgacagaaagagtgatcaaaactatttcttttctctgtgccactttatttgtttctaaaaaacggtacatgaaaattcttttcagcagaccaagaacatcctgcctttcaagtctaagacttatttcttgctcctcacactgaagtcttatgactaagtcgcctactgaaatgacagcagagtgtttatccctgctctgcactaatctctcctttcattaacatagttgttgaaacagagtactatgatatttttctacatgtaaccttttcaagacctttgtcgataccctatcaacacgtggaataatgtacctagacctgagatcaattcagcaagggaatgaatgatttactctatgaccttgggtgtgacacattacaagatatctaacatggctaattataaaaacaactgtttaatcagcacattgttacctatgagaacagtggacaattaaactggctcacatgctaaatcaggaaatggagcagatcagcaagagtcaaaggactatgcccttcccctgtccaacctaggcaacactattgctgtcttttttgctctgttttaatctttatacgcaaaaatttggcctcggattgatgtaatggacaatttttagctccatatccatcttattaggcagccaactcaaatatctagaagcacagttgagaataggaaacaaaaacatcttcaagagtaattaaaaaaaaagacacaacgcatttgtataccgtgtccatagagaagttttttggggttttttttgttgtttttgatgttttgagacagagtttccctctgttgtccaggctggaatgcaatggcgcaatctccactcactgcaacctagctctcccgggcactcaagcgactgtcatgcctcagcctcccaggctcaagcaattttcatgcctcagcctcctaagtagctaagattacaggcatgtgccaccatgcctggattatttttgtatttttagtagagacagggtttcaccacgttggtcagactggtctcaaactcctgacctcagatgatccgcccgccttggcctcccaaaaggctgggattacaggcctggactccataaagaagttttacagtgtttgaaagtgtttaggccgggtgcggtggctcacgcctgtaatcccagcactttgggaggccgaggtgggcggatcacctgaggtcaggaaatcgagaccatcctggccaacatggtgaaaccccgtctctactaaaaatacaaaaattagctggacgtggtggcacgtgcctgtaatcccagctactcaggaggctgaggcaggagaatcacttgaactcgggagatagaggttgcagcgagccgagactgtgccactgcactccagcctggtgacggagtgagaccccatctcaaaaaaaaaaaaaaagaaagagtttataaaatataagttcttcaagtcctgaatcaaaaaatacttattttcattttaaacataattccaatcattttggtctgatttctcagactaaataaaaactaatgttagcactaaaaggagtaaactaccctagtatctaagaagattactctggtacagctcattcacaataattacaaataaactgtgtacaatatattaagtctgtgtataattccattaataaaattagctaaacaagcaatttgcaaaatgagccatggagttaggagtggcaaaagattagcagaaaaaaagcacactaaaatagagatgaaaattatgcttttcagaaaatacaatgtcactataatacaagtaataatgaacttccacatataatattttcaagaagaaaattagtgagaatctaataaattaataaatatgatagctatttttaaattgaatataatgaccccagatccactataaagaagaacaatatcatcaataatatctttgagagacaaaaaaaatatagaaaataaaatatgcaccattattttagtttttcccaaggtaaatatcagggatgcgggaggaatcatcaaacgaaggcaaagtgccttgaataactgataatacaacttaagccacttaagaaaactaaatagttacccatttcttgctgccaaatgaaggggtgtacagcctgaaatatcttgatagttaggatttgctcctttctttaacagcaaaaccaagcattccaccgatccacaactaaaacaatattaaaagacagttcagatacattcaacatacagccatacttgatgtagttcaattaaaaaacaaaatattctattaaacacaattttctttttgtttttcagacagtcttgctctgtcgcccatgctggagtgcagtggcaccatcacagttcactgtagccttgacctcctgggctcaagcaatcctcccacctcagcctcccaagtagctgggacttacaggcatgagccaccacaattgggtaatttttttttttttttttctgtagagaagagacctcattatgttgcccaggctgatttcaaactcctgaactcaggcaatcctcctacctcagcctcccaaagtgctgggattacaggtgtgagccgccatgcctggccttaaacacatttttttttttttcttgagacagagtctcgcatgtcacccaggctggagtgcagtggtgcgatgtcagctcactgcaagctccgcctcccgggttcacgccattctcctgcctcagcctcccgagtagctgggactacaggcacctgccaccatgccaggctacttttttttgtatttttagcagagacggggtttcaccatgttagccaggatggtctcaatctcctgacctcaagatccgcccgcctcggcctcccaaagtgctaggattacaggcgtaagccaccacgcccgtccttttttttttttttttttgagacagagtcttgctgtgtcacccaggctggaaagcagtggcacaatcttggctcactgcaacctcagcctccagggttcaagcaattctcctgcctcagcctcccaagtagctgggattacaggcgcacgccatcacgccgagctgatttttgtatttttagtagagatggggtttcaccatgttggcgaggctggtctcgaactcctgacctcaagtgatctacccacctcagcctccaaaagtgctgggattacaggtgtgagcccctgtgcatggccttttaaacacattatttttacctataatttgatttaacttctgacacaaatagtaaacattctctactttcaagatggtccattctactatgaaaattataaagtatttgagaaattcaaatacttcaaagaaaccatatgatactttcaaccttctggcctttcgtaagccaaattattcatgaaaaattaatttcaacacatctacctaaatcctgaaaagaggataggtaccaattagttaactgattgattacataccaggagactgtagataaaaatcattctccacctatgtaaaaaatataaagccaatgacttcatctgcagacagcatataaaatctcatattgctgggataaaaagaaaattttggtgaactgtaccagtaagtacatccaggaaagacaatctccatgtctaacctactctcatctgatataaaacaaagacaagagggacatgagatttacatacaatcccaaagttaacagtttagagacagaacggatagcacaccacgcgctcaaacaggataaagaactactcagctgtctgttctcatctctccccagaaatattgtgtgataatgctgttcaaagcttactgatccttgccctagatcagagtttaactcaaaatatctttagtcttactttgctgcaatgtgaagcaagcttcttttcacacgtccgaatgcataattgacatcaaattttgaatttgatagtagttcagaaacagacctatgccaaaataaaaatgaggaatcaagtgtaaaaaaagtttttaaaaacataataaatcaagttaacaactctttagctgctctgtttgtttgtttgtttgttgagacaagagtcttgctctgtcaccaggctggagtacagtggcgagatcttggctcactgcaacctccacctccctggttcaagcaattctcctgcctcagcctcccgagtagccaggactacaggcgcatgccactacacccggctaatttttgtatttttagtagagagggggtttcaccaagttggccaagatgatctcaatctcttgacctcgtgatctgcctgcctcggcctcccgaagtgctgggattacaggcgtgagccaccccacccggcctagctattcttctgattcttcaggttttgtcccacacccaccacaaaatactgcactattctcttagtatgttagccagctcagtatcatccaaaaaccaaacgccttgaccaataagctggtgctgaaggtttcctcatctgccacttggataatcctatgttacctgctcttaggacacacaacagactaagctggctttagctttccttagattcttgagaaacaaagggtgtaggcctggctgctccccttgccaaaagttgagcctagctatattaattttggccaaataaagaaaatcagacaaaaaacattttttaattataccaggtaggaaatttaaaacaaaaaaaaaaatttttttaacttgtttcaaaatagtttctctttacattcttcttcttatatcaaaaaattcaatggctagccatggcagagctgactggtgtaagtgtaaagaccccctcacaaagccaaataattgtatttcatatatggccctgtaaaagaatgtcaacactacatcaataaaaggaacacaaaaataagtagcacataagggaaataagttgtccctcagccataatcttttactataaagatcagtagtgacctctaaaagaaatcatgacaatgtatttttctatgtgagtgaccaaccaaatacttagtatttcaatattcattaagaaaatctatcataaaatgttacagctcatatagatcttggaaaatcttattccttatttcacacacacaaaattataacagaaaagttaaataacttgccccagaacatctatgtccaaactgtctgtgtgtgtgtgtgtgtgtgtgtgtgtgtgcgcgcgtgcgcgtgcacgggcatgcagtacacatttagaacaatgtatgcttcttaaaaagcaaaaatttttggaacaagcactcacctgtgttgatcagccataaccattggcattaatgtataaacagcagtttcattatctgagtaaaaaaaaacaaagagttcatttatcccctactttgtgcaaggggtgatacttaagattagtttagaattttcctaactctatacaaaaagcgaaaaggagaggaagaaggaggaaagaataatgcagaataccagaggtatttcagaatttacgatagtgaagaatctttcatcccctccactgcttatcccttttacatcattacaaaagagcttagcttctggatgtaaaaggacaattaaagactgattcttcagaaggttttgtcccattatccaccaaaaaacaattctctaagtgtagtatggtagcccgcgcatcatcatccaaaaacctttctgtagctttaacaattgaaatttcttttacttccaaagaggtatttataggcatcatgttttatcatacttacatgtagtttgggggaattttaaatatatatggatattaaatatatatatgctaaaataattttaaaaccttaaatatacacaatactggcttcttgtcaatattattacaaaagaaattagtttagaagcttttatgaaagagcactgaagtcttcattgtacttaccactttactcacaacatttttattcatatgtgctatggtttgaatgcatctaccaaaagttcatgtgttggaaatttggttgctattatggcagtgtgaagaggtgaggctttggggaggcaattgagccatgagggctcctctttcatgaatggattaattctgttaatccaggagtgggttagttataatgaagttcagcacccttcctctctcaccgttctgccttccaccatgggatgactcttactcgatgctggtgccacactgttggacttcccagcttccagaactgtgagaaatacatttgttttctttacaaattatccagtctgtggtattgttgtatcagcagaaaacaggctaagagagaccctttacacaataaattcacaaaaacatgacccaaaaggttaaaaatcaacatctatgatgccatattatacttatgtacattttagctagtgttttgaattgatttttatatattactaagggtcatttctcaattcaatgtattttggaggtttatgttttttaataaattatttacaaagatgaaaccctgacaacccccactcagccctttaaaagttaatgctgatgctcagttaataggttaaagtttaaggagaaacaagatatttacacagtatcaagtacctctcaaaaatactgactaattacaaaggaaaaagaaaatttatagtgaagaacccagcagacactatcttaatcaactgacaaagggtaacatcaccaaaaataatatatgctcaatatcatatagttactgatatgatccactgaaaggggacacatcacttttgcagtacagcagtccccacttatccgcaggggatacattccaagaccccgagtcaatgcctaaaaccatggatagtaccaaaccctatgtatatgatttttttccctacatgataaagtttaatttataaattgggcacagtaagagattaacaacaataaataataaattaggacaattataatactatactgtaataaaagttatgtgaatgtggtctctctccctctctctcaaaatattgtgctgtgcctcccgcaactgaaacctcggaaagcaaagctgcagatgagggtggactactgttcttgccaaaaatgcataacttcaatctaatcatgagaaaatgtcagaaaagcccaaattaaagggaattccacaaaacacctgatcagtcctctttaaaagtctcacgaccgttaaacacaaagaaaaactaaagaactatcacagtttggaggagactaaagaaacataactaaaggcaatgtggtatcctgaattggatccgtaaatgacattagtgggaaagctggtgaaattttaacaaactctgtagtatagttaatagtatacacaaatgttaatttcttatttttgacaactgtactgtggttgtacaagatgttaaccttagggaaaggtgagtggaagttacatgggaggaactctgggctattcatgtaagttttctgtaagtttaaaattactttaaaaaatacttattttaaaaggaggaggaactgtcatacattaagagtcttaagagacacatcaaccatacgtaatatgtagtccttatctggatagtgattcaaaaaaaaaaactgtaaaaggacatttttgagacaatttttgagatgaggacaaactgtatatggacttggtattttatttcaagataatacaatattactgttaattgtattggctctagtaatggtattataattgtgtttgaaaaacataattcatatgtttagaaatataaactgagctatttataggggaaatggaaaaaagttatcaatattccttcacatatttgttcattattttactgtgagtgtatacatgaaaaacaatttagtccttggcaacattcacaagttcagtatgcagatgcaacaactttttcactataaaagtaaaatactaataaatcctattaataacatttaagaaccattatcttaaaggcacttttctaaacactttgcatgtatcattgcttttctcctcacaaccaccctatgaagtaggtactattatcctcattttacaaatgagaaaactgaagtactagttaagtaacaagctgtgtaacagtggcattatgtggctgattccagagcctctacaaataatatatcctggctgggtgcagtggctcacgcctgtaatcccagcactttgggaggccaagtcaggcagatcacaaggtcaggagatcaagaccatcctggctaacaaggtgaaaccccatctctactaaaaatacaaaaattagccgggtatggtggcaggcacctgtagttccagctactcgggaggtcgaggtaggagaatggcgtgaacccaggaggcagagcttgcaatgagccgagatcatgccactgcactctagcctgggcaacagagcgagactccatctcggaaaaaaaaataaaaaataaagataaaaaataaaaagataatatatcctacaatgcacccagtatataccacataaccagaaggtctacaatagaatactattcttaatatgtaaaatagactctgttttatcctcttatatttctttttttaaatgctgactgcaacccactaattgctctcagaaactaccaatgagtcaccaccaggagttgaaaatactacactaagcctcccttggcatgacaacattctttatcgttcatataataatacatgtcccaataaaaatctgaacttctaaaccatgagaatttccattaagtcaccccataataaagtcataaaaaacactgttatttgtgggtttaaacttaaatcaagataaactttaaatcaagatagtgcataattttaagtgagcgttagtgagcataataaggttcacaatggttgtacttgtaaggtttttattttttagataaaaattagatttacatcttaagtcacatctaacctaaagaaaaaagtaggtcacatacattaacaggtaagtatgaagaaataaatctaaccacaactgtggtgctagaagaagactatccaagaaatactatactaagaaaggacagaatacaatttgttgccagatacttccttgtctactcttgaagacaccttcaggattaggtatataattaaagtctccagggtgacaagaaaagtttaatctatcactttattagacatgtttgccatttttatcactacagtttcaaaacccaactgttaacaaaaaaaaggtgctcagagtaattaattatatacaatttctcttcaaaccatcacatggagtaatttttttaaacacaattatcccaatcacatatgctaaaatgggctcaaattttattattttattaaacaaactgcattcactatatagtagttcaaactttacatacactaacaacatacaccttccttttatttatgtgttttttttttgagactgagtttcgctcttgatgtccaggctggaatgcagtggcgcgatcttggctcactgcaacctccgcctcccaggttcaagcaattctcctgcctcagcctcccaagtagctgggattacaggcacccgccaccacatccagctaattttttgtatttttagtagagccgggggttcaccatgttagccagctggtctcacactcctgacctcaggtgatccacccacgtcggcctcccaaagtgctgggattacaggtgtgagccactgcgcccggcctccaacttttaaacactactaagaatccatatccctaaagtaatttcttactcttcacctctttttctctcaagaatattcctgtgttaggcctgcctaggaggactcaactacctgcactccattacttagggtaatactcaggttttcatcatctcaaggaaacatagcatccaactcagtttatcaaacatctatagtttcaacctttgcaacaaaattaattttagagtacaagctgactaaaaagtttacaagtttaatagtttgttgtaattagatgcttattgattactgaattctaacaaagcaaaaaaaatctgattattttctaaatttagagagatctcagagtttccattcagctcttaaaatgtaagcacaaatgtggatttgtatcagtaggaatgttatatatatatttacatatatatatttatttacatatatatttacatatatatttacatatatatatatatattcctatatgtatgatatactttaaagagccaagctcagagaattcaaagactcatcagagcttagagacaaagataaattaaattcaaggaacaaaatgaacattataatcaaagaaaagcaaatgcaaacgatgccatttttgcctatgtggaaaagttttacttttactaataatactctagtttctgggcactctcggactgctggtggaactttccaaggagtaagttgagaaactgatatgttgagccttagaaatgtattgtagatattcttcttgtaagaattaaccctaaggaagtatttagaggcagactatgtcttaaatacaaagctgtttctcataaaatcagtttaaaaacagtatttagattcaacatttgttacatgcatcctatgaaattctgaagtcattaagcctattgaagaatacaaaaaaaaaaaaacatttggggcggggcacggtggctcacgcctgtaatcccccagcactttgggaggccgaggcgggcagatcacgaggtcaggcgatcgagaccatcctagctaacacggtgaaaccccgtctctactaaaaatacaaaaaattagccgggcctggtggcaggggcctgtagtcccaactactgggaaggctgaggcaggagaatagcgtgaaccccggaggcagagcttgcagtgagtcgagatggcgccactgcactccagcctgggcgacagagtgagactccgtctcaaaaaaaaaaaaaaaaaaggatgttttctaaacacaaaataaaagactatatgcaacatgattttaacttgttagggagggaaaaagaaataacaatggtaacactgtttataactggatggtgaaatgacatatttttttctatttttctttattttccaaattttctacaatgaaactatattacttttaaaaccaagtaacattatcaaagtcttctaaatcacatttatgtaaaaaatatcgggattcaaactagacaatataaattatacatgtagtcttcataaagctataccaataattcgactacgaaaaataagtaagagtagcacttaagaaatggattcaaaggtggaagttggaaagaaaatatagaaaaagttgaagctagaatctagttaccaaaatctgaattctaaatagagactagagaccattttttcaagaagattatccccaggccaggcgcggtggctcacatctgtaatcccaacactttggggggagcagggtgcggatcacttgagcccaggagttcaagaccagcctggggaacatagtgagacctcatctctataaaagaaaggaaagaaaattatcgccaaagtacccaatcccacatttctttcatgaccgtctgccaaggtctccttccctatcctacaaaccacccagcagcaattcaaagagagttttgaaaaagtaagataaactactacaattaagaaaaaagctattcaccagctacaacctcctcccaacccttctctcacttgggcataaagagccaaaagcttcttagaagcagcactgctgtctcccatcaccactaaaatgtctgaattcctgacgctgcaaacaaaactgcttattttctctccttgttattagcagagttttacctgtcctgagggaaccctggcacgctgaactaaaagtcctgatcctcagggaccatgccttattcctctttgcagatgcgtcctagttaccagctagcccactcaatactagtctgatgaataaatgaagaatgaaggcaggcatgcatattaaagaaaaatatattgtgtttacccatacagtactttaagagtacctgtttgatgtttgacaaccctttgtttgcctgttatcaaaacaaggcagtgccccacattttaaaaaataacaaaaataaaagcccgcctggccccccgatgcagcttaaagtaaacagtatctttggatcatctctatccccagctactgttaaatgacccgcaattatgatgttttctgactccgggtctcgggcctccggctggtattcctgcccctttgccaagacccctaatcgacagacgttgcgagacctttgtctcgctcctcccagcagcggaacccccaccaacccagtttcctcccgaaaactcccacctgccggggtgggagcgtcgggccaggggagttcggggcccggggccgcctctcagctctggaaagtaaaagtgggcgttttctcagctttcagttagtttttccacccgaccttgacgcggccggagctcctgccccactggccgcccccagccccgcggccagcctggccccgcgacccggctcaccctcgggcaactccacggtgcgcgcgcggcgcagcgagcgcgtcaggcggttgagttgctccatcgctctctccatcctcggcgcgccctccgcgatcctccgcgatcagccgccccaccggcggcctccgcgcccagagccctacatctcgcctgggcccgtccagcaggcggagacgcgggcttgccccggctagagcactgagctgcgagggctgcctggggccacgtcctgcgtccgggggccgggctgctgccggaccgaccacctacagtacacccgccgccgcctctgctcgcgcctttcctgcagcccccgccgccgcgtccctcccgggctcgcgtggccttct

SEQ ID NO: 1097 - DNA, 71 bp, Homo sapiens
tggcacccacccgtagaaccgaccttgcggggccttcgccgcacacaagctcgtgtctgtgggtccgtgtc

SEQ ID NO: 1098 - DNA, 11852 bp, Homo sapiens
ccaaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcccgcctgggcctgtctcctctgcttcacaacctactctgagcgcctccgcatctgccagatgtttgttgggatgcggagccccaagcttgaagagtgtgaggaggccttcacggccgccttccagggcctctctgacaccgaaatcagtgaggagaccatccacacttcatcagtgtcctggggaaggtgcagagggagggcaggagaggcccagagggtcaggctgagggacagacagagagaaacagtcagaggagaaaggctcaaagaccatgagaacaacagagacttagggacagagagacacagacaggggaagacagcagggcaaagactcagagaggggaggatggagagtcagagaggggaagatggagactcagagagggggaggatggagactcagagagagaggaagatggagactcggaaagatggagactcaggagtatggagagtcagagaggggaggatggacactcgggaggatggagagtcaggaggatggagactcatagaaaggggaggatggagagtcaggagaggttggagactggagagggaatagagacccagagaggggaggatggagactcagagggtggaagatggagactcaaagaggatggaaacccagagagaggaggacagagatgaggcagagactaggggaagcaggatagcgactggtcgggggcagagactcagggaggatagagacttgggagggactcaggaagcatagcgactgtggggcaaagagtcagagaggggaggatacagacttgggagggcagagactcagaaacagaatgttcgcattagggacatggtgttgcggggagctgcctcccccagcccctgctccctccctcaccgccagactatgatgagagaagccacctgcatgacaccttcacccagatgacccatgccctgcaggagctggctgctgcccagggtgagtgtgtggggatggggagatgggagatgtggacttggagcccctaagaaatgggtatgtgggagggcccagggcagaggaaggaggcccccagagttgggcagtgatccgggaggggaaagctgggaagacattgagctcagctacttgtccaaacgaaggctgaaggcagctctaagagccaggggctgaaggtggtgagggggaagggacgctgcagaaattgcctagagctggaagtccagatggggtcgggtaggcataggttctgccatggctgcatggctcacactcttactggctatgaagttctgggtgtgtcactgcccctctcctggcctcaacttacccatctgtaaagtgggacaatcttcttgcctcctaggatggccatggagctcagtgcaggggttggggctgcctgatgagcctgatcttagggaaggcatcttcctctaggatagaacacacacacactcgcacacagacacgctcagagacatacactcacactcacacacacacacagatttcttataaagtgattccacatttttgaggtgtgaggcaattagagggcgggaaaacaggaacagcagagtggatcactcaggtgacagcagtgaaaagagacaaggtgtgactgtcctggtgagacaggcacatgtgacagccttgaggtgtgtggctgtgcgaagagacctcagggctgggggccacgcaatgccgatgggcagcatgggcggtaatcatgcctgatcaccatggccatgatccccacgaggtgccagaccctggaactgtggaggctcggagttgcaggagttacagagccctgcgctatagaataaactggcttcctcttaggtccaggagctcagggcttattcccacacccacagtcgctccttttgcttcctgctttgccctccaagcgtcctgtcaacaatcccggaagagggaaggttcccatccacccagggggcatccagggccagcctggagaaggcctcagctgtggctctccccatctccaccctaaagggagacctgaggccctaaacctctccatgtgggggtgtgcaggattccaagaaatgccctttctccccacataggctgccttgttacagaagcttttgaaaagatgaggaacctttggatctgggaatggaagccttctgtggggccgcatgggggacaaacttggaggggagagagaagaggctgggtgagggtccaggccagagcggaggcccgagtgggggctggggccgtgaaggtggagaagggccagggccagagagttaggtctgctgggctgttttgggaagcatagagaacagcatctgagacaggtcctgctctgtgcctgttgggcggtgggtcatcaccgaaataaggagcctgagagaaagagccgggggcagatgataagctgggttagaaggcagtgactttgaggggtcccagggacgtttaggaggcagctagatacctaggtgcagagttcagcagaaaagtcagagagtgttgagtctctttcctcagggcgctggggagctgcagcaggagtgtgagcagtgaagaagtaggggcagctctgggtgtagaaagaaccctctggggtcgtgtcaaagatggaccagagggagagtctggaggccgggagaagctggtgcaatacgttcaattatacttactgaatgtgccaggaacaaccgctgtgaccaaaactgcaaaccacctgtcctcgggttgcttatattggggtggagtctggggagatagacaataaacataatcgataaaatatcttagtatcttagtatgtcagttggtgatccctgccatggaggaaaacagagaaggggaagagaaaggggtgatagtttttttgtttttttgagatagggtctcactttgtcacccaggctggattgcagtgatgtgattatacctcactacagcttcaaactcctgggctcaagcgatcttcctgcctcagcctcccaagtagctgggactataggtgtgcgccaccatctttggctaattttttaaatagtttgtaatgatggtgtcttgttatgttgcatgggttggtcttgaactcctgggctcaagtgatcttcccacctcagcctcccaaagtgctgggattacaggcatgaactaccgtacctggctgggtgataattttaaataggttggtcagggcaggtggaaatgacagggtccagttgagcaaagacctgagcaaggtgacagtgacagcgacagccatgcagataatctgtggaaagagattttcaggccacagggaatagccagtgcaagaccctggggcccgtggggctggagtaaaggtgaaatcagagagatagcaaggggccacctcctgtagatcctcatagacagggggttctcaagccccagcatacatcagaatcccctgggagcttatttaaaatgcagatttctgggcttcaccacctctgaccaggaggtccaaggtagggcccagacatggacgtttctgtcaagatcccagggaatgctgatgctgctgctccgggaacactctttgagaatcactgttgtaggcccttggaatgacttttgttttttgctcttgaaatgggggagctgttggaggactttacacagagagacaggatctgacctgggatttaacaagatctctctggcagctgtatggggcctggacaaaggcaggaagacttccagtgagaagccggcccatggtggcttggaccagtcacagtggtccgggggcccagatgaggtctgagcagagtggggtgggcataaggatttgaccgtgtgccaggcttgcccatgcgtgcaaaaggctgtgtttgccatacacagagtcattcatattaagtatcttcctaaaggatatcctctaccggccctgtgaggctgggttttatagccccgcttatcagaagggaacgctgggctcttctggacaagaacagtaggcccaggatatatttggagatagactggaccagatgtaggtgggtgagggcaatgggaagaatcaaggatgacttttgcgtctcctccagagggagcagcagggagatggaggagctgatgtaggctgactgcctcttggtgatcccaggtgatcttatttgtatatatgtatatataaaccatggagtagatgacgtggtacagactggatgcagtattaggtgtggagattatgtatgcagcgattaggtgtggaggctctggagcctgaccaccagggtcaaatgtagccatgtgattttggaccacttctctaatctccccatgcctccgtttccccacctcaaacttggagatggcaatcctaagtttgccagccttctctaacactcactacgtgctaggagccattctacacacttagtgacaccatctcatacaatcattaaacgatgccatggaagagtggggatgaggatgctttcatggttgtatggcgtctcatcctcccgctaattctgtgatacagacactgctgtcatcctcatttgatgaatgaggaaactgaggatcaggaaggtgaagtcacttggccaaggtcgcatggggaggagggcttgtgattgatactcagatctgagacaggtgtgctcaagacggaagcaccaggactcagacccagatgatctgaaccagggtcagagctcctgacgatatgcaactcctctgggggagactttacaacacccacccatgccgccttatggcccgcttgctataacccaggccacttggcctgttcggaacatttcactccacttatactcccctggtggagtataagcccacccggccaccatggcttacttggtatatcccacgctcaccctgcccatgagtcatttgatttggcacatagaaattctttggatgactcctccaacatcctggcctctcatttgtgcaccccagtctgaccacatgctcctgatcatcctgccatcttgagaccacactcctgctctgtggccaaggagagaccactgggtcctcatttggaacccacttctgggcatcagtgcttcctctctccaagtgtatatccagtgatcattgttttaggcactttcttgccaatatcctcagttccctccctttttgtatggctttaatcacagaggacgctttcccctgtccctgcaatggctttaagcccgtaggaagtttagctctcctatataaagtaagtcttgtggtaggcacttaaggctaatatggcacctccatttcttggggatccaagctccttcaagacttaatatcccagggagtagcccttgtcctcatggtcccgtgtggctgctagagctccaaccatcaaaacaaattttcaggcagcaggatggatgaggggaacaataagatggcaccaccttctctgtctttgttttttagagacagggtcttgctctattgcccaggctgggtggagggcagtggtgcaatcatagctcactacagccttgaactcctgggctcaaccatcctcccacttcagcttcctgagtagctaagactacaagcacaccatcacacctggctaatttataaaaatttgtttagagatggtgtctggatatgttgcccaggcttgtctcgaactcctggcctcaagtgatcctgtcacctcagcctcccgagtagctgtgattccaggtgcggtaccacctcccttttaaggccacctcctgtgactcacataacacatccatttgcatcctatggctacaacttggtcacatgaccacaactgcaaggaaggctgggagatgaagctttttatctgtgttctgtggatataggttatagatatataggtatttggaggcagtgaacaattcctgtgtgttggtttgctaggaccactgtaacaaagtaccgtagactgggtgactcgaacaacagaagtttctgccttctagaagtctgagaccaaggttttggtgtcagcagggttagtttcttctcacgcctctctctttggcttgtagatgccttccttcatatgtccctgtgtgcatctctgtgtcctaatttcctcttctcataaggacaccaatcatactgcattacagcccaccctaatgacctcattttaacttaatcacctctttaagaaccaagtacagtcacattctgaggtactgggagttaggacttcaacatacaagtttggttgcgggggatggggggtgggcggcacgatttagccgataaaaccctgccacattactgatttccacaaatcaccacgagatcaagtcagctgtctattcttattccactggaacaagccacaaacccatacaatttggaggccattgcagtggtcaaaacacaaggccaggcatggtggcccacacctgtaatcccagcactttgggaggccgaggcaggcggatcacctgaggttaggagtttgagaccagcctggccaacatggtgaaaccccatctctactaaaaatataaaaattcgccgagcatggtggtgggtgcctgtaatcctagctactggggaggctgaggcaggagaatcacttgaacctgggaggtggaagttgcagtgagccaagatcacaccactgtacgccagcctgggcaacagagcgagactctatctcaaaacaaaacaaacacctacaaagacaaggaacataaaagagtaaaagatgggtaaatatagaagtgaatagaggctggggactatggagaagtggccggtgtgtgccccatttcaagggagtgactgctacccatctccagctaattgctgccttatggaaatgcgatctctgtgttacagctcttccaactttgtaaaaaagagatgccaaacgttttatttgacattccaaattttatatgttggcaactggttcattttcttttaaacactttccaggccaaatataacacatcccagggatggatttgggtcataggccaccagctggggtctccagttcaagttggatcctggaattcattgtacaaatacttactgagcacttctaagactgagggccctctccaggatccagaggacacagtgctacagaagaacatgtttatttacttacgagacagacataagtgatcatcatctatatataaatatatgtaattgcagacagatgagagctaggaatgaaatgattgcgatgagagacaaaaacagggaacttggttagatttgtggtgatggaaggatgattaggagaaggaaaaatgtgctaaaaacaagccagcatgtgcaaaggccctgaggtgctagggaatgtggtggttttcatattaaaggaaatgaggccaggcacggtggctcatgcctgtaaccccagcactttgggaggctgaggtgggtggatcacttgaggtcaggagttcgagaccagcctggccaacatggtgaaaccccatctctactaaaaacacaaaaattagccaggcgtggtggtgcacacctgcagtccctgctactcgggaggctagggcaggagaatcacttgaacccaggaggcggaggttgcggtgagccgagatcgcaccactgcactccagcctgggtgacagtgagacactgtctgaataaaataaaataaaggaaatgaaaggtgggcagtagggatgggacagggagggagggggaactaggccaaaccatgtaagacctaataggccttggtgaggaatttgatctttatcctccccttctccccccaacaagctacatgcaggtgatgtccaggaggacttccatcctggagagattcaggaggcagaagaaaggagacttagggacttgttagccttcaactacagagggcgggtgatgagaagaggagcagagaatatggtaatgagaggggtgaagaggggccagggaagggcagataccatgacagtacgtcctgtgagctagggccagcctagccctagccaggctagatcagaatgcaggaccaaggaccaagccctgggggaagggctttactacacaggccgtcctcccctccactctccaggatcctttgaggttgccttccctgatgctgcggagaaaatgaagaaggtcattacacagcttaaagaaggtaaaatacactccatctctccttccccagacacacacacacacaattagaaaaccccacttttggccggggatggtggctcacgcctgtaatcccagcactttggaaggctgaggcgggcagatcacttgagatcaggagttcaaaagcagtctgaccaacatggtgatacccatatctactaaagatactaaaattagctgggcgtggtaacgcatgcttgtaatctcatctactcaggaggctgaggcaggaaaattgcttgaaccctggaggcggggttgcagtgacccgagatcggcactccagcctgggtgacagagcaagactccatctcaaaacgaaacccactcctgagaccccccatccactccccgtacaatcccctggccccatctctgagcctcagaccttgagggacgactatttccccgcgtggaccatttttgatctggccccgccccttcgatgaaaggtttcgtctccaactgagcccctttccgggactactactaacctggccacgcctcttctctaactgggccaccaccttagccttggtctcctgcaaggatcgcccaggatctagccccgcctcctcggtggaatacacctggattgcccatccccatcagggcctacagaaaaccagtgtgtttccctctaaaccccaagtagaaggctggcagcagtcctgggcctgacctcctagtggaatgctcaggcttggccccggccccaggtggaacccagccggcttgaccccgcccccaggttatgacgaaagcttggccccgccccctcggagcaatgcttcgggccttgtaacattagctaggggagcatcgggcaagggttcttcccatgactgtaaggtagtgatgtttcctcttcctccacagcccaggcttgcatccctccctgcggtaaggacttcatctaaaacttggaaattgcggggtaagggaggcggtcggggacgaaacgtacgacatcaagtgtgggaaagcgggtgggcttcacatccttaggaagccaataagatccctggagaaaaggaagaaaaccaagtattgctctaaatcctcagaaggtgtgtgtgagagccgaagcaaaccaataggaatcctagagggcggagaggagtgagagtcggccaaagacagcagggagggcggggtcaagatgccacctggccgatggaccccgggaagctgcatggatctcaaatgggccaagggccccgggcttggaagggcaggtggcgcctagacccagcgttcccgctccacaggtctccaggagttcgcccggcgtttcctctgcagcgggtgctactctagggtctgcgacctcccgctggactgcccaggtgagggggcggggcctcggggtgcaggaggccaacctgagaaaagggaccagagcaccgaggggcataagctggtggcgaggccagacgtggtcggggcccagcgagtgaaccctgctccgtcttcagttcaggatgtgacagtgactcggggcgaccaggctatgttttcttgcatcgtaaacttccagctgccaaaggaggagatcacctattcctggaagttcgcaggaggaggtgtgagtcggggcggggccggcgcgaagagtttagacgggcgagttagccttcactagaggttggggagtcagcttgcggggacgggactccgggaatctccgtctagacacaagcatcagcaagaggagggtcgcgggatttaggggagagctcgaagatcagaatgcaggaccaaggacctggggcgatggctcacgcctgtaatcccagcgcttttggagaccaaggcgggaggatggcttgagcccaggagtttgagaccggcctcggcaacaaattaagacccctcctctgccaaaaaattttaaaaacagccggggcgtggtggtgcacgcctatagtcccagccactggggaggctgagcgggaagactgcttaagtccaggagtttgaggctgcagtgagctatgatcgcgccactgcactgcagcctgggcgccagaacgagaccctgtctggaagaaaaaaaaaatacataaataaaagcagtttctaggggtaggttatgcgtaagggtttaaggagtgaggggaaggggtgcgtttagggcaggggagcgagaaggctcgggggcgggctcaaggctcagggccaggactccagggggcgtggtctggctcggggggcggggcttgtaggttactcagtggcaagccggagttgaggcgtttaaacccgcgtgtcccgcagctccggactcaggacttgtcctatttccgagatatgccgcgggccgaaggatacctggcgcggatccggccggctcagctcacgcaccgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctggggactccggagccccagcatctagctccccgctgtctcagatcccaccgagaagtctgggttcccagcaacctccaacccaggaggtcaggctttcagttcctcctctctcagacccacgagtccaggtcccagcccctctttactagcccaggaatccaagtccccagccccctcctcccttagatctaagagtccaggcccccagcccctcctccctcagacccaggagtccaggtccgcagcccctcctccctcagacccaggattccaggccccaaacccctactccttcagacccaggagtccaagtccccagtcccctcctcccgcagatccaagagtccaagcccccggaccccctcctccctcagacccaggagtccaggcccccagcccctcctccctcagatccaagagtccagacccccaagtttctcttccttcagacccaaaagcccaggccccctgccccctcctccctcagaaccaggagtccgggccctgtacacctttttgaccctggtgtccaggctccgggacctaagtttctagtcaccaacccctcctgtaacacacatacctctttgtttccccaggatgttctttcgatggtactgcagtggcaactaacaaaggtatctttcctccttccctatcctatttccatcctgaaaataaagaatatatttcaactcta

SEQ ID NO: 1099 - DNA, 80 bp, Homo sapiens
ccccgggctgaggtaggaggttgtatagttgaggaggacacccaaggagatcactatacggcctcctagctttccccagg

SEQ ID NO: 1100 - DNA, 87 bp, Homo sapiens
ttgccagtctctaggtccctgagaccctttaacctgtgaggacatccagggtcacaggtgaggttcttgggagcctggcgtctggcc

SEQ ID NO: 1101 - DNA, 172036 bp, Homo sapiens
tttgggtgtggtgatgtatttattcataatatattttcagaacacattaataatggagaataacacttattcatatactgaatataacttttcctggagcactctagagcttgtttggagttggagaatactgccaggcttttcctaatctctttggtctttggaagtgggcagggtttctcaaaccaagtgtcttccatgggccattggcaaaggcttcccttcatcagcttggaggggcagaaagaccatggcttcagcacttccattttggaaagaagtaacaaaaaagtgaattaatgagcaatcggaaagactcaaagcattttgtactccacagttcatttcttcacacaaacgtccattactgcagcgggcatgaaaaccggcagggtgttaggctcatggcctgaagagaagtcacatcaccagccgatgttttcatgcaaaaggcaatcgtgatgattcagaacctggttctgaatttctccaggtgtgctcgtgagctgaaggtcatgcccattctgtgcatcctgtgtctttctactggtaaacttggatgtcattttagagtatcttggcaaaatggtgagaggatctcactttcccaatatcactctgtaatgaagctgcttgggggatcctccatttgattgtggagagaccaaggcaccgtgggctgaagcaacgaatattaacaacactaacaacaataaggataaagtctaagtctcttccaaaaaaggcatatccaaaaataagggtaaagagctggtcttatttcatccaagtgattctgtgcactggaaattgtccttccgttcctccctttcattaaaagtgtttatatttctgagtcggatgatcatttaaatacatacaatattagcaccaaggcagcatatttttttcccagagatcacatgaaactgaatacttatttaacatagttaatagttggtacaatctgtgatatcactaacatacttattggctgatacttgcctagaaatgccaaaaatatcttttatacaactcttatagcaccttgatgatggctagattgttttaaaaaaattcattttaaaaaagtaacaataaaacatttacagatgaaaagtaaacaatagtgtaccgtgataatgaaggatcactttgtcatattactacatgcaaaggcagtcataatagaatcattttacgtacaaaaatattacatcacaataaataatttcaaacataaatattaaactttacatcattaggatagtctacatatctacatacacacatatatgtgtatatatgtatgtgtagatatgtatatatgtatatgtacacacatttacacacacaagcatacaagtcacacacaaacacacacacacatacacatgcacccaaattaaggtggaggtattgcattactatccttcatccatccataatggcttcctcttcaaagcacctgaaataaacaaaccagaaaatataaaccttctgcctcaaatgctgcaagttaagaataggcaactgataaatttttacatatagaatttaaaattaacacttattattttctctagattttatttttattttttctgagtcacagtctcactctgtcaccgaggctggagtgcaatggcatgatcatggcttgcttcagccttgacctcctgggcaagcaatcctcccatctcagcctcccaagtagctgggtctacaggtgcaaaccatcaagcccagctaattaaaaatggtttttttttttttttttttttttgcagaaatgggagtctcactatgttgcccagctggtctcaaaatcctggactcaagtaatcctcctgcctcagcctcctaaagtgctggcattataggcatgaaccaccacgctggccctagattttaaaagtaatgtttgtttgctgtaagaaacttggaggtttcagggaagtaataaacaataaaatttaaaaacccactagcctgaaatccccccacctgagataactgctcttcatatattggtattttggtatttccttctagtcttttttctataaatatatgtttatatatgtaaatattgtatatacgtgctatataaaatttatcttcttagatacaaaatatataaagtacgtatataatggtgatctctagtggatacctgctgatttttccatgcctccatcccatctcctcctttctgataacaaaatgccttcttgtcctttgggaaccatccctcttccaactgaagctgtcaatcgcctgactctaggtgggtacatgatctcagatccttggatgttgtgatttgttcaaaagcgaccatgcgacctaaccagagctaaacagagatattttgcagaatgcatgctaggagatgagtgtttacttgaatcataagttggaagaatgatgtaatcctagagctgcccaggaccatggtgtagggggcaatgatctgcctgagaatgaagacatttaagaggcaatcattgctgattgatgaagaaagagagtactgatgactgaacttctggatctagccatgcctgaagctagcatacttcttggatatctcagtttcttaagataacaaatttccttcatttccttagctccttgtaacagaaataatcctaaatgtcaaataggcactcttgtatcaggatcttcaagagccttacacggtaatgggctactggaagcttgagggaagatgcaggtgggtcacatgaattggttgagctcattccttgcagctgaagacatggggatgataaaaagactgaccagttccgtcttttactcagcagaagaatcaccttctggcataatgtactcaggtcagggattgccgaactttaacatgcatgactcctgtggactttgttaaaatgcagattctgatttcacaggtatagggtgaggcctgacattgtgcatttctaacaagttcctaggtaaagctgatcgagctgattcttggaccacaccatgagtaacaggggtgtggcacagtggagtgattaagagcactggctttagtgtaggacactctgagttctgccgagggaatttatcattaccttttcattttttttttttttttttttttttttgagacagaggcttactctctcacccaggctggagtgcagtggcggggcgtggtcttggctgactgcaacctctgtctcccaggttaaagcgattctcctgcctcaggctcccaagtagctaggactacaggcatgtgccaacacacccagctaaattttgaatttatagtagagatggggtttcaccatgttggccagactggtctcaaactcctgacctcaagtgatctgcctgccacagcttcccaaaatgctggaattacaggcatgagccaccgtgcccagcctcatcatgatcttaagcaagttacttaattgttgtgggcctcagcttcctcatatgtaaaatagcagctcctccacacagttttgttgtgaggattcaatgaaatattgctcaacaaatgccactgtagttttactattacattcttgggatgtatttctcaaaggatgagctgtgattcacttgcattagaattctctgtattaaagttacagatccctgaatccaccagagacctaatgaagcaggacccctagagatgcagcccaataaacagccttttaaataagctctgcaaagagctggtaccaatcctattgaaacaattttttcaaaatcgaagaagagatattccttcctaactcattctatgaaacctctatcatcctgataccaatacctggcaaaaacacaagaaaaaaagaaaactacagactaatatccctgatgaacattgacatgaaaatcctcaacaaaatactagcaaactgaatccagcaacataccaaaaagataatctaccatgatcgagtggactttattcttggcaggcaaggatcattcaacatatgcaagtcaataaatgtgattcaccacacaaacaattaaaaacaaaaacaatatgaccatatcaatagatgcagaaaaagcattagataaaatccaacatcccttcatgataaaaacctacaaggcataagacatcaaaagaacatacctcaaaataaaagccatctctaacaaacccacagccaatatcatacttaacaggcaaaagttggaagcattcctcctaagaatgggaacaagacaagaatgtgtactctcaccactcctattcaacatagtattggaaatcttagccagagcaatcaggcaagagaaagaaagaaaagacatcaaaagaggaaaagaggaagtcaaattatcttccttcactgacaatatgattctatacaaagaaaaccctaaatattccaccaaaagattcctagacctgaaaaatgacttcagtaaattttcagggtgcaaaataaatgtacaaaaatcagaagcatttctatacacaaataacattcaagctgagaaccaaatcaagaatgcaatccaatttacagtcaccacaaaaagaataaaatacctaggaatacatctaatcaagcaggtaaaagagctctacaaggagaattataaacattgcttaaggaaatcatagatgacacaaatagaaaaacgttccatgctcatctattggaagaatcaatagcattaaaatgtccatactgcccaaagaaatacacagattcaacaaaattcccatcaaattaccaatgttattctttacagtgttagaagaagaactattctaaaattgatatggaaccaaagcagagcctaaaagcgaaagcaatcctaagcaaaaagaacgaagccagaggtatcatattaccggacttcaaactctactccaaggcagcaaactaaaggtaaccaaaacagcatggtactggtactaaaatagacacaaaaattaatggaacagaataaggaacccagaaataaagctatacatctataaccaactggacttcaacacaatcaacaaaaataaacaatggggaaagcacaccctataataaatggtgctggaaaaactggctaaccatatacagaagaatgaaattgaactcttacctcttaccatatacaaaaaataactcaggatacattaaagacttaaatgtaagacttcaaaacataaaaattctagaagaaaacccaggaaatactcttctgaacattggcctaggcaaacaaattatgactaagtcctcaaaagcaaatgcaacaaaatgaaaattgataatggagacctaactaaattaaagagcttctgcacatcaaaagaaactatcaacagaataaatggacaatctacagaataggagaaaacatttttaacctatacatttgataaaggaataatatccagaatctataaggaacttaagcaaatcaacaagaaaaaaacaaataaccctattaaaaagtgggcaaaggacatggacagacacttctcaaaagaagacacacaagcagccaacaaatataagaaaaaatgctgaacatcacttatcatcacagaaatgcaagtcaaaaccacactgagataacatctcatgccaatcagaatggcgattcttaaaaagtaaaaagataacagatattggtgagactgcagagaaaaatggaatacactgttggtgggactgtaaattagttcatcctttgtgaaaagcagtttggagagttcttaaagaactaaaaatataactaccatttgacccagcaatccattactgggtatatatcaaaaagaaaataaatcattcaaccaaaaagacacctgcactcacatgtttattgcagcactattcacaatagcaaacgtggaatcaacctaggtaccgattaatggtggactggattttaaaaatgtggtctgtatacatgatgaaatactatgcagccataaaaaataatgaaatcatgtcctttgcagcaatatggatgcagctggaggcaattttcctaagtgaattaacacagaaacaaaaaatcaaataccatatgctcttgcttataagtgggagtggaatactgggtacacatggacataaagactgaaataatggacactggtaactccaaaagggaggaggaagggaagggaaaactatttattggatactactttcactatttgggtgatgggttcaaacgaagcctacatctcaacacactataacagtgtaacaaacttgcacatgtacctcctgaatctaaaatctaaaagcaaataaataaataggccagctctgtagaggggaagccatgtctaatggcagagaactgatggcttcagtcacgtgaggacagaggagcaggagataaaaaggtagaactgtattgggtcagcttcaagatgcttaactgtaaccctgcctgatcctcccacatttgctcatataggctacagaaaaaaataaaagacaaatacacagacagacagacataggactacttaccttagctataaaactcgcacctccaggccagtaccagaggatggagtgcattttccacagtaaccaccgcatttccctacgactcgggtaccatcctgcaaggagatgcatcatgttagcctgcctgcttggttaatgctttcagggcctgcactggctttttgggaaaacgttcttatacacacagtaaacaggccttctgaactgatgtgaagcccaacatactcaccatggtctaaagcaggggctggcaaacttcagcctgtgagccaaatccagcccaccacctgtttctgtatggcttgcaagctaaggatgatttttatatttttaaataattgagaaaaagtaaaccaaaaattacatttcttgacacataaaatcatatgaaattcaaatttcagtgtctattaataaagttttattggaatacagccacattcattaatttacctgatgtctatagctgctttcatgctgcaaaaaaagaactgagtctcagcttcatactgcttctcggtgcacaacaaatcacagtgacattgttttaatttgagagtgttttgagtgatgtgtgtattgctagatcattacaatttatgtgcttattaccagtgtataccattatgacaaatcaagaaaagaagagaaaggtagactttgaatgttgcacttttaaggtacaatggcatgtggattattttgttatcaaatttagatgacaaaggattgtgattattatgaaatgacactatagctgtgctaaaagaatacaatatatatcatcaccaaactaaatactcatcacaatattcccaactcacagaaaaacaatggtcaaaaatttagaaaatttaaaatataaaattaaaaaacatgaaaatgagtaagtttccaagttgctcatttgttagccaagcaaggaaaacaatttaccaatggtgagttcattaaatcctgtttaacagcaacatctgaagaaatgtgtccagagaaaataaacttaactactcttttggcaaggactattgcttgaaaagctaatagcattgggaaccacataaacagtcaattaaaaaaacaaagcagattattttgagtggttttcactggctcttaatgggtccacacatattactgatgttattcaggtgttatcatttctttgaggagaaaatgcccagtctgaagtgactaaagaattagactctatgaagagtctagtggaactagtggaatagtggaacaatttgtggaatagtggaatagtttatggaacaagtacaggtgagaatatttcaaaaaggttgggaaagaactgcagaacaactgaagtggaatctgctaagacgtgttgacaactgatgatagtaaaaatatgtgtggagcataaaaagctttaactggacaaatttacaaagcttgcgaaactgttagatgtttaaagcctatggttattcactgtattattcatttgcaggtactttgtggaaaatatttgacctatcaagtgctatagaactagtagtatcaatagtggactttattttctaccacggacttacccatcatccattttgtgaatttttttgtcagaactgaaagctcaataccttgacttgtcctactacacagcaatttgatggcttagcagtggggtaaagttttattttgatttttgagctcagggtcaagattaaagttttttgaactacaactgctctcaatcactgtaattcaacacttaatggctctgaatattagcttttgcttcagagttgatcatgtttctcaatggattgtacctaaaattacaaggcaaaactgttcttataggcaaaacttatacagtgataaagtaatttcactgataatactgtttggatcacaagtaacgttagattgttttatacacttcccatgctgtcaaaagttaaaacaggaaatgtcttctctattacacacaaatttaaagtggatatattttctgagcttaaactgcagttccagcactgtttttcagactttgatataaatgcaaaggaaatctttttatgtcaaaatccatttaactagcaattgaggagcttcaatctcattttcaattgcaagtgattaatatgcaatgtagtgacatgctaaaaggcaactatcaagagaaaactctgatagaattctttacttgcctgccaagccatgaatatgcttaattaacattatatggttatggacagatatcagtgtttggcaatatcaatgcatgtagaaaggcatttagaaagattgaaatacataatatctcatttcacgtcagcattaacagataaacatttacaatctattttgataatagagaacactaattaagcgaaatattttcctcccccaatatcccattcatctcctcaggtgatctgtattagaaaaagctatactcagttattatgattgtattttgaatttgaccaataaaaaaattttgtgcaaatttgttttctctcttgacatacaaatataccattgattttgcctcttggcccttcaagactaaaatctttactatctggcactttgtagacaaagtatgccaactcctagtctaaagacctgcgctccatagagtctgtctttgcctctgcagattcatctggtaccattctgtactcaacacatgcatttctttttgttattcttctgatatgtcccatacattacaaggcctttgcatgtgccattctctctgattggagttctcctctctctccctctctgtgcatactgtaccacctcaattttggcctggtaaattcttcagaactcagttcaaagcccatttcttctgagaaaccttcctgacctggttatctgccgcaaagcaccctgtaaatgggtaattctttctttaacatctgtcttcctactggaatgtcagctccattatgacaagaccaataccttgttaaaacctgggagtatccagaacctaccacagtgtgtggctcataacgatacgaaatatacatttgttaaatgaatgaatgaatgaaaggctgaagctgaattcttcttttggaagtgtagttaagaatgccctgctgatcagttccccttatgctttaccatgctatgaaaaagtccttctttaattatggcctcatattccattttgtataataaccatgtcacataattccacccctccaccctctgcgcctgcacaatattgcatattttccacttctggaaataacactatgatgaacatatttgtgcctacattttaggattttttggggttacattctcagaactaagtcaaaagtcatgaagatttgcttcacacagctgaactaagaaagcctcttgaaaacaatggataatctcattttaaaaaaggaagatgaatacaaaaatataattagaataaataagttatagtatttattttatttttatttttttgagacagagtcttgctcttgtcacccaggctgcagtgcaatggcgcaatgtcagctcactgcaacctccacctcccgggttcaagcgattctcctgactcagcctcctgagtagctgggaccacaggtgtgcactaccatacctggctaatttttgtatttttagtagagacagggtttcactatgttggccagactggtctcgaactcctgacctcaaccgatctgctgagattacaggcgtaagccaccgtgcccagccaagttatagtatttaatagtacagtagaaaaattatatttaccaatataatataatataataaacatttatataaaatttatgtataaaatttatataaaaatattttatatattttatatttatataatataatatatagtataatgtattataatcttatgtgtgatatgctatactatatattataataaaataatacaatatatagtatatattattataaatatatttactatagatagttaacaataattgtatatttcaaaatagctagaagagaagaattgtaatgttcccacctcaaagaaaagataaatgtttgaggtgttgggtatcccacttaccgtgatttgattattacacattgtatacacgaatcaaaatatcactagtataaccaaaaatatgcacaactatgatatatcgataaaaataccaaagaaagaaaaagaaaaacagtgccagtttaacaataaaataggataaaatagtttctcttaattcttaaaaattcgtaggcatttgatgatgaatggaactgagttgggagagttatttctatcctcccacctggtcttggttttagaggcctgtggtagttctggagctggcccataccaccagcaactgaatttgatgccagactaactggtcttcagtgaagaactttctcacctggcttaagtatagggccagggccttcacgatacaggcagacaaagaatgtcttctgtatcatcaaaacttatgctttactcaaactctcctgacccagcagaggagctaacctgaatcagactgcctggagcttgtactacatcttgaacaacctctttacgcctcagttcctggtacatctgtaaaatagggataataatagtaccccatcacgggtttgctgtaaaggagataatgcatgtaatgtgcttagcatagtacttggcctaatatatgtgctcaatgaatattaactgctattatcataaaggtatttttaatgtgtaaatatccatcatagcctgttttcagggaaatgggtaaaagtctgggtaattataaaactataaaatttaaaaaataaagccaatactggatttataccattattgctatctccttaagtgggattccattatttaatttagataaaggctgagctaaaacttattgatcctaaagaataaaaacagccacacggagcaagtaaataccaaaaacccaattgtcaagcagacagtgactatttcagaaaagaaatatattagaagcacccactcacattccttaaaacactaatttttatttcttcattaaagcaggccttctaaaaatctcttttcgatgattattttgttagcctggtttgagctattacatataattaaatgaatgaatctctgttccattaagaatagtttgtatttcatacttttcactaattcttctatttttttcaatctatatgaggaaggcagattggcttctttgatttaggaagaccagcatacctttgactggagtgtgctaatttaaagacttatttaaagttgtcagaggatgctggtggtagaagcaagctgagttgggggtggaggtggggattttgataagaaaatccatacagatagtaatgaacagagattataatgattatggtataatgtttataatgattatggggctaaaatctgcctgggtcaagattacatgcaatgaaatttatcgttgaatgtccctgaaattgcccataaaacacagcatatagggtttttttttctgaatatagccctggacacttatgtatatatgaacatatgcataaatgtctaatttctataggaatatacagaataaaaattagactacctaaaatgtaaatgtacagcattttactctactggtctgtggtatgatttttacacttggtggatagttggattttcataagctgacagcaagttcggaggcagcccaggtcgaaacatgagagtgggctgcactgagcatgtgtgtgtgtacacatgtgtgtttatttcaggtgcctgaactccactgtttgcaagtgaattgaaggataggaactgaatccatctcttctatggtaacacaactttcgttattttttaacttcaaagcaattctttgatttacagcccttgctctagcccaggaatgtctgttagaccatatctcttagaacagtggccctagttcttccctgaccctgaaaattcctctggcacacaaggaagacaaaaagccccgtaagcgcctctcacacccagccaggacgtgatcatcctttcatgctgcctgtctctgaaggcctattccagaatcttctacctggaagagaccaaaatgggtagctctgagaatgggcatggggagctgtggtggaattctgggtggggctgaagggaactttcacattcccacacgttggagagttgagggtatacagcgttgctggcagaggagcttgaaattctgacattttctttcagccttcatctctgggccatggcctcctttctgtctgtctgtccctcatgcagatatctaagcagagtgaggagaaactttacgacccctagctgagctggtgcagctaaaacatttgccctgaagtccacccccaaccaaggggtgtctcacacgacttattcctggggtcaggtggcagccatgtggacaggctaagcccgggcttacactgcagttcgatgtccttcccaccagctatctcaagccagctcccttccttagtcaccttggccaacttccgaaacaatatggcaaacctcagggctatgaaaacgttataacattaatagccagtacttgtgctcctgctatttgcccagtaggataccaacagctttacatttttatttcatttatgtttcacaataagtcaatgagaaaggggccactacagtccccattttatagatgaacaaactgagtcccccctctccccacccccattttcctggaagttaaataacttgcccaagatggcagagccagtgggcacagactctggcagtcagatttcagagtccacgtgcttcacctctgggctctgcagccactgacggttttcactgtggcaccaagggctgagttgcggcaggttggagaggctgatcccaccacctgctcaacttaacatcccaagaatttgaccttattctcaccttgttatcccaatctcctggtgacagcacagctgggaggaagacacagatttaatgtatgtaagctgcccaataaatagtagctattttaaccataattaggttaaaaccagagaaagagtgctctccattgttcacaaggaagtcaacagtgaacttgatattgagactgattttgaccagttctgctcttggaagtgagacagcgttactgttcttcaagtggtactggagatctagttttacctgaatcaatacagctttcctttagttttgcttggggaaaacattttattgccaaggaggtttggaaaattgaggttttcatttttttttttcccttctgtaactcctggcagaaaagcaaaagaaagtgaggaatgattatttgagagctgaaacagggctatttggaaaagagagtattataactggccagggtctgagcatcccagagaagactgggccacaggccctcgggggccagatcgtagtaggtatcgagtgggaacaggatatggcacaattcttgaagtgtgtttcatggaaccctggttatttgggggaaattacaagctgtaacttcgaaaagaagtttttgtgcttggcttcatttaggttagtggttctcaaaatgtgactccagatcaggggcatcagcatcaccagggaaatggttacagatgtcaatttctggcctctcctcagactgatcatgtggtgggttttgttttgttttgttttgagatgggtcttactctgttgcccaggctggagtacagtggtacaataatggctcattgcagccttgaccacccaggctcatcctcacctcagcctcctgagtagctaagactacaggtgcacaccaccacagtcagttatttaattttttttttttttttttttttgtagagattgggtctccctgtgttgcccaagctggtcttgaattcctgggctcaagcaatcctcctgcctcagccttcccaagtgctgggattatgggcacaaggcactacatctggccacctgcttgtgttttcacaagccctgcaggtgatggtgaagcactcctgagtttgagaaccactgctttagtggaatgctggctaaagtcacacaggtttatttcctgtataatttagtcccacctcacatgctaatgcttactgtgactcttcaggaaggaaatacaatatactagcattttctcccaaaagtgttgggcggtggaagcctattttcaggtagcattgctaggacatgcttctctggaccacacgggggaagtcagacagcatttctccagacagccgggggctagagagggctcagtcccagctcccagatattcatgaggagtactcgacaggccctggagattaattttgagctcacactctctgaactgccaaggaacaccaagatttaaaaaaaaaaaaaaaaaaaaaaatgccgacaggcaattgtcatacccagctccctccagcccaggcatctcccaaaagtcttggggaacagccagtgtagtgatcattctttccataaggtggcgctcctggctttaattatttttagtttctggctgaaacggtagtaactatctaacgaataaaattataatttaggttacagtttatctacatgggtttcctacaatcacatttttatttatttatttacttatttttttaacagagcctcactctatcacccaggctgcagtgcagtggcactagacaggcaaattttttggttctgggtcactgaaacatacagtgtatttcaaaacatcatgttgtacacgataaaaatatacgatttttatttgtcaagagaaaagaaacataatgtatagattttggagggaaggaatggggaaagaacattataatttcggggcacattctaaagctcatgcactctctctcagctatctttattcctttcagtgcaaggaaaaatatttaatgactaatttacaagtaatcaatatgactatttagttaatcggatttgaggacattgattggctgagatggagaagagagagagtgagatagctttttttcacagacacaaacttaatcatggcagctagaaaaagagatcaggaaacagattttcctggaatgtcccaattggacgtttctcctctttctcaggtgagggaggcaggttgagctgcttttttatagtcttattttgattaggtagaagtatttgcaatagggttttcagatttagaaaataaaaatacaggatgcttggttaagtatgaatttcagataaacaacatatacatgtttagtataactatgtcccatgtagtgataacagtacacttattgtaaacagtgttcattgtgtacttaaaaaaaaaaaaaaagagatggtgtctcactttgcagcccagcctggagtgcagtcgcgcaatcatggctcactgccctcttgacatcctgggctcaagggatcctcccacctcaacctccaagtagctgggactacaggcatgcaccaccatgcccagctaatttttaaagtttttgcaaaaccagggtctcaccaccttgcccaggctggtctcgaactcttaggatcaggcgatcctcactgtgtatttgaaattctaatttaactgggtgtcctgtattttatctggccgttctgccttgtaataaaaccctactttcccagctctcttctttgtcttcccctatttctgaggcaaccccaggcagggctcctggctgagatgggacgggagaaatgggccatgcctgggtaaacttagacatttttccacgagccgggtttctgccccacgttctcaggacttcagagggaaggctgtaagtggcagcggtttctgacctggctgtacatttgaatcatttggggagctttaaattctactcctgccaggtccccccacccttagagattccgattcagctcatctgtgtgggaaggacctgggcaggtgcatttaaaaattcctcaggtgattctactatacacccacggtgagaaacagtacacagtcgacacgctcctcagtttacaatggggttatgtctcaataaacacatcgcaagttggaaatatcattaagtcaagaatgcatttaatatatctaactttctgaacatcacagcctaggctagcctaccttaaatgtattcagaacacttgcattagcctatagcagggcaaaatcatctaacacaaagcctattttataataaagtgttgaatattttgtgtaattgattgaatactgtacttagtgaaaaacagaacggctgtatcggtacctgaagtagggtttctaccgagcgtgttctgcttttgaaccatggtgaagttgaaaaatcaagtggaaccgtcgtaagtcagggaccatctgcacagcacagtgtttctcaagctgtactgtgcccatcaccacctgagacactgttcagctgtagactctgactcactagggtctgggacccagaacctgcatttccaacgggcccccaggtgacactgatgcactgcgtagaccacaccttaaccacccagattttagagggtgaaaaacttattattgtagaccctgtgtatctctaattctccagatatatcgcttaataagttatctgtcttctagctccatctgtatttcaatttttctaaataaaaagaagaggtcatttcccctcggttcatagaacgaaccgcaagctggctaactgaaagatatctgagccacactctcgacagaggcttcttcctgcttttacctccctggttaggtggtttttctaattacttggatggttcatatgttcacctctcgaggaagaattcaccagaagtgaacaaggctctcacactttaatcacgtgtaaacactgcaccctaggtttatttcctaaatggtcttcctgacactacaaaatggcttaagtgggaaagcacattcgtttgctccttcagcaccactaccacagtaataaagacaagaacgaaagaaagaaataaaaattcatctcccaacccatctgtagaaccttaccggcgacttcttgatgtcagagacagcataattcccttgtgatatccatctggcagattcagttaaagacaagccggttccataaaggttgatgctaaaacgaccctggaaaacacgaccaacaaaagagattttcagtccatgtgatgtcctcaaaaaagcaaaggcaaaggtgatacaataaaaggtactttggaaaagagaaggatgttgattaattgtgatagctactaattattgatagtatttagttttgtttgttcagggccagccattcttcatgcatcatgttagtcatcctcgaaagagctctacgaaggaggttttctttacagatagggaaactgaggcttagcggaagtgattaacttctccaggatacggtaggagtccaactcacatcctcctgacttcaaagtccttgctccattcggcctccctaacacagcagtcctgatgttgctcacaattatcagattccttcaggaacaaaatgtcacagtgtaatttttctaacaagatcttggtgccaagcttcctgggcttccagctccctggggcgattagcacaccgcgtactaagcacagcagggcgggacttcaaagaagaggcgctttccccaggacggtcagcagagggcagggttggcctgctcaagaccacctgggcctggaggatgcggctttcaggctccggtaagggagatctcccaaacccctcccctccgagggtgcctttcagaacatggcctctggtgcctcaatattgatttctaaagagacggtgcagcagaaagaccctctcgctgctttctccaattgtctctctcactctctctttcaaaaatgactcgcaaaggcatctgaaatactttcttcttgaggcttcctactccacaatgagcagtttcagagctaaaaatattccacatgaacactcctgattgctttctctctgaaactgacaaaccagcactttgtcaaaacagtcttttataaacaagaagagaggcaaggaggagctcacagctgatcagacccgcgtgtaagaaaaattctttcacctgtgattggatcctggccagatcttttctcacctcttggaacctcagtttattcatctgtaaaatggaaagcactaaaactctcttccctctgagcaccgtacagaggactaaaagaaatcagctatggctggcgcttagtagatatgcaaaaagatggtatctgtcttacattttctaattgttttgtaagtgttcgtgtgatctcttcaatgtaacagtaagcttattgagagcagggccttactattgctttgtttattgaatcagctatggtttgtaacatacgactagccacttaaatattatatcccagctcctcaattaagatttccaggactaagtgtagcttagaggtctctcaatgccagttccataaatattgactaacaaaagtttataaacacttctggagtgctagattccacaagatagaggtgaccagaggacttagtttggactaaatcagtggttctcaacagggcacgattttgaccccaggggaaatctggcaatgtctggaaacatttttgtttgtcacaactgtgggggggcagggaatggtgctgctgttggcatctggcgggtagagaccaaggatgctgctgcgatgcacaggacagcccacaatagagaattctccagcccgaaaagtgctgaggctgattgaaaacctggtacaaagggtagatttaccctagaatcttgctcccttctttactttcagcatgacctcaggcaaggagatcatctgtaaaatggattagtaagacttaacctgtgaataggaggtgattagacagaaggcacaatgcacgtcacgcattacctggcagacagtaggtaatatttaaaaaatatttttgggctgagtgtggtggctcacacctgtaatcctagtactttgggaggctgaggcaggtggatcacctgaggctgagagttcaagaccagcctggcccaacgtggtgaaaccccatctcttctaagaatacaaaaattagctgggcatggtggtgtgtgcctgtaatcccagatgctcgggagactgaggcaggagaatagcttgaaggcaggaagtgtaggttgcagtgagcccagattgtgccactgcactccagcctgggcaacagagtgagattccatctcacatatatatacatatgacatttttatgacaatatgctacagaggttcatggttcttatgtggcatggctgccatgctcaggtgtttttgattgtagctgcactgaagccccctcagacaccggattctgtatgttgcattattccattggccattttcttttcttttcttttctttttttttttttttttttgagacaaggtctcactctgtcacctaggctggagtgcagtcgcataattttggctcactgcaacctctgcctcccgggttcaaatgattctcctacctcagccttctgagtagctgggactacaggtgtgcaccaccacgcccagctaatttttattttggtagagatggagtttcaccatgttggccaggctggtcttgacctcaagtgatccacctccctcagcctcccaaagtgctgggattacaggcatgacccaccgcacctgccaccccctccccccaaaattttcttatcttactatcattcctgcccccaggagtgggtccacataactcaaagtgcccaggccatcctagtgccaagaatgtccctcttttctccctccattctgctttccactcagactgcctgtcccacctgcactgcaagagaaaggagacttgatctgctttggcactgaagttttccggaggtccaggcggctgacccagcttctttctggacaatgcccccagccgacctgggcgtccagtgtctgaacatgctcaatatatacgtctactaagtctgccttcccagaggggttgatgaacccagatgcaacaggagatcatcctcctcattctccttctgccctttccagtttagggatctgcatttcagcaaatgtcctagctgattgttagcactctgaaagttgagttccaccagagaagtaaagacctaatgttctttctggctctgctctgggacatctttgcccttaaaggccttatcttcaaggtctaaagggcacatgagttgtaaataccaccttctgttgcctattctaaagaagagtgattgagagttatacgtttactagttggtccgtaaaggtttgcaaaagatgtgcttagaccaaaggataatcctgttttctgttgtacaggagcaaatgttgcagaaatcttgcctgaaaacagaatcaaaaagacatgtctactatcatggatatgaattcagacacacttaggttcaaatccagactctactgagcggcagctgtgtaggtttgggcaaatcctcccaatttctactccttaccctcctcctctttaaaaaggaggcattttcatagaatactgtggtgatttaaatgctacattgagtagacaatactgagtacagtgactaaagcaaagacgcataataaatgctagctattaataccatcaataataatagtgtcacatctactgtcatcaggataaaaaatattctggttatgtttcaagatgagggctgtcggggaatccactcttattaataaatacatccacaaagcaatagtggtcaatgaggtaaaagaaagaaattctcaaacacaacatcattctgctttgatttctgtgcaatcactaggtcaaaggctgaaccacctactccgaagcagtctccacaatcacgctttctacaaaccttttcctggaaaactgatttgaaaaactcacatcttgcatcagtgtagctggtgctcaatatgtgtctaaggaattgaattcttaaagtacccaatatggtttgaagaatgagctgggaaaaaatacaaattagcctctctcaagctttgggttttctcatttaggaattgcttcattgtcaggatttagcaaatcaatcagttcatttgtctctgaattattaaaataaatgaatgcaagttacttttcatttacttaagcttcccaaaggatgtgcatatagaaacaagaaaatcctgagacatttgaaaaaggcaggacagggccaatctgttagccactaaaatgcaacagataccaatggggtttttgaagccatcaattgccctaaaaaaaactgtacttcaaaagtttttgattcctgggtaatggaagaaaggctctttttaccattatgtcctttgtttattttccttctctcctgagagcttcctctccacttctctaaaacgtttagcaatgctcttctaaagcttgaggccgaaaaaacgcctcgttaaaacaacgttcagatgtgtttgtcttcggacgttctctgtagttgggggtaaatccatcctatggagacagggcttgggattctgaacgcgtcacagaatcccagtcttcagacttttgaaggttcacaggcaaagtaagaaactcttgacagagtttaacaacagctttgtgaagacctcctttaaacctaagagaaaactggccaagttctcctgcccagaatcactgagttcattatgtttgtcctgccttccaagggcagaagcttcttgtaaagactaacgtctgctttgcaaaattagcccgagctgattatgacaaaatgtttcaaaagacaagctaaaacttgccacgcctctctcaggcaagaaagtgtagaaccacagaatgggcagaaagattgctgctgagtggctccgctgaaaagccatccaacagaagatgatgaatttgcacttctggtccgaacactgcagacgttgtagaactgaagtaggggtaacaggttgagtcaatgacatccacagagccgcaagccttggtcccggaggacttctagaatatattattatctcatggatattcgttaacctgtcatcctctctaataggctacagatttctcaagggatgaatgtttgtgagtctccagtaaaaaggatggtgcctggcacaaagtgagcacttgagaaaggtcagctgttttgttgctaagactattctagagccatttctgactaccattcaggaaccaaaggaaacccagataagtcttgaaaattttgagatctccccgtccaacttttatttatttttttaaaaattggtttcatgcttactctgaaaaatttaggaaacccggcaaagttaaacattaaattaaaaaaaaaaaaaccttaccaatgcacccaactaatattttgaaaaagtccttccagactttttctgtttatacattaaaagaaaatacagatgggatcatactgcatgtagtgttttgcatcttgttttttctgtctaatccatgtaaagtgtttttctatatcatgcaatattcagattcataaaggctgacagtggtgtgttggcacgtgcttgaactggcttttgagagtcaactgtctgccttcttcctagccctccatttagtgacataatgttgacggcttgaaatcaattatagggagaatatttacaccatggcaattgacaaatgttacaaagcaggaccttttttttttagaagtgtcagtcattaaatatttactagcactccgctgactgtacaatattcattttatttaccaccataatttgtttaaccaagccctcgctaaccgacatctaatttgtttctaagttggcgtgttttgttgaatgcagaagttaggcatgtagctatgatcatttccttaggacccactttcaggagctgaattacgagattagactccagagcatttgagagggtcttgatacatgtggccaaactgccctctagagcaactgttctaatcacattcccaggaacagatgcaactgaggatgttcccgggaaaggtgggaggtgaatccctggcaagggggaaggcaccaaggacatacctgtgggcacttggcagcgctgtagcaatccccggctgtggcaaaagggacgggatgtccttcgcttgtccttgcaaactgtaagtcagtggctgtggggtggagaaggggttaaaggcaggggaaggtaagagtgggagaaaggcaaggaaggaacaggacattaacaaggagacagaagggaagaagaagaataagagggaatgggagagaaagaagcaatgtgaaatattagtgggtaaatggatccagatgctcacttgctttttcctgattatatttgtggttctgcgagcttcattccccgagcttcatcagccccgaatgtctgtctccccacagtatggaagccaaaaagggggtttcaaatgactttggaattgattcctacataaataaatatgtgaatcacctcacttaaatgtagcgtaattggctggctgagaacctcctgttatcctgcatcacaggcttcaggccagggggaaataagccaggaagagagcatttccagctacttaggagcgattccctgaggtttcctctgtcctcctgttgcctaggcagtattattgccaaaatgtggcgcaattagaacccccatcttgaaattattgacagcagtttctcaagttcggggctagcctgtaattttttattttttaaagagccaataaatacaaggctaacccaaagtgcacgttgttaacccctactgtagctcctgagatgagctctgcacatgcaaagggaggagttaacccgagaatcctgcaaaagctgtctgccagggagactggaggccagaggcaggtttcatctttctgcctcgtctttcaggaatggccttaatcttcctacagttcactacactttggtgagagggaaatcccagtgctccattctgcaaggaaaggggaccttgcctgcttcagcatgtagaacccttgggtcttagctggggtgttttcctaagtggagaaactgcagaccctctgcctttacccctcatcattctagctcaaggaaatttaaagtatcttggtacaaatcacgtttaatctatctcaagagaaaaggaatgcaatattatgggtataatgttaatgaggaaaaattaattattcattatttctgtttttcctttatgcaagggaacatgttgaggtattttagctgtctttaaccactcctatgattaatgtccccaacagagatgcagtgttggcgagagtatgaaatcagcccacacacaggctagtttagaaaaggtaattctgtgttccatttttcttctgcacattgacgactgaataaaattagttttacgtctgtgtaagcatgtacactgtgctggcgaaagctgggctgggggtggtgaatgttgcccatgaatttcttggctttggggttttgtatctgctgtttattctaccttgaacacttctgctaccagctctgcttcccccacactgacccctgtgcctggctaaccctaacttgaccttagggtctctatttcaatgtcatattttctggaatgctgccctgacctcccacatttcaatggtgcttctttcatgcactttcacctacttcattcattcattcattcattcagttcattcatcacaaatcggagagagcacctgccttgtgcgagccactttccaggcactggggaatacagcagtgaacaaaagagacaaaactgcctgcaggactatcctcgctgcactgtaagctcccaatgttcttcctctccatactagccaatgtgcaatgtgcaatgtgcaatacgcacctccctgctagccaatgtgcaagacatgcttgctgtctgaatggagagaagaacgcacacgttcccaaaggactcctcactaacttactgattatctgcatgctggtcaggtctattctgattttctgaaaactggaaaacccagcggccgtgtaatccttccgacattggcagtcatcgcgccggctcccgttatagggacattctgttgggttgtgtaacctaaattatacagagaatgttctggtaaggatgggaaagcatttccagggatctccaggcctctgagatcttctgagcctggctctcctacctgtgcccataaacctcggagaaattctcagagtctccatgcaccagtgtcacgtactctttggggtggtcagagtgcatccccgcacagaatatctgaaagaccataaataacccatgaagagtggctcagaaatgaggtaatgagagcggtgatcactcactctaaaaacattcttgaaataatgactggtgtctgacattcaccttcagaagctttcctctaatcatcaggaaatattcaccatcttcactggcacctttaagtctttttacctccttgcaattctggggtaactcacctagaaaacaccaatcacaaaaaatagggtgtgatgatccgagatgtgaattatctgcctatagaatgaatgacattgttcgcactaaaactttttagcaaagcgaatgatttccttcagaaaaaattctatatttctaaaaagggcaggcaatcaaatgaacaaagacatcctgttcttcatgctaaagaaagataacttcagttggccaacttacagttatagacattacggcaggtttttcgttcttctggcttcagatcagtgtggcataagtggctgggttggtcctcattggttaaacattgcacagatctctgcatcactccaacaccacaagacactgagcactgtaagacaaatgagagtcagcggtgtggctatggaatgtgggaggcataggcttctggtggtgtggagctcagagccctgatgtcatcatgtacagggtgtcacttcagaccctgtgtcgctgaatacaaaaagctgacatttactgagcacttactatgggccagtccctgtggtaagctttatagattcatgttcatgcatttatacaaacatatatatgtataaaacacttatatgtgtaattttacacacacacacacacacacataattttttcatttaagcctcacagtacccctatgagatagtattaccattatcttatttttacaggtgggagattggggctcaaatttaaggaatttgttcaaggtcatagtggagccaggattcaaaccctaactgcttccaagtcgttatacacttttgcctgatcacttttcatttctttctttcttttttttttttttgagacagagttttgctcttgttgcctaggccggagtgcaatggcacaatcacagctcacggcaatctccgcctcccaggttcaagcgattctcctgcctcagactcccgagtatctgggactacaggcacgcaccacctcgcccaacaaatttttgtattttattaaagcagtgtgtagagggaaatatatagtactaaatgcccacaagagaaagcaggaaagatctaaaattgacaccctgacatcacaattgaaagaactagagaagcaagaacaaacacattcaaaagctagcagaaggcaagaaataactaagatcagagcagaactgaaggagatagagacacaaaaagcccttcaaaaaatcaatgaatccaggagccggttttttgaaaagatcaacaaaattgatagaccactagcaagactaataaagaagaaaagagagaagaatcaaatagacacaataaaaaatgataaagggaatatcaccaccaatcccacagaaatacaaactaccatcagagaacactataaacacctctatgcaaataaactagaaaatctagaaggaatggataaattcctggacacatacaccctcccaagattaaaccagaaagaagttgaatccctgaatagaccaataacaggctctgaaattgaggcaataattaatagcctaccaaccaaaaaaagtccaggaccagacagattcacagccgaattctaccagaggtacaaacaagagctggtaccatatccttctgaaactattccaatcaatagaaaaagagggaatcctccctaacacattttatgaggccagcatcattctgataccaaagcctggcagagacacaacaaaaaaagagaattttagaccaatatccctgatgaacatcgatgcaaaaatccttcataaaatactggcaaaccgaatccagcagcacatcaaaaagcttatccaccatgatcaagttggcttcatccctgggatgcaaggctggttcaacatatgcaaatcaataaacgtaatccatcatacgaacagaaccaaacacaaaaaccatatgattatctcaatagatgcagaaaaggccttcaacaaaattcaacagcacttcatgctaaaaactctcaataaattaggtattgatgggacatatctcaaaataataagagctatatatgacaaacccacagccaatatcatactgaatgggcaaaaactggaagcattccctttgaaaattggcacaagacagggatgccccctctcaccactcctattcaacatagtgttggaagttctggccagggcaatcaggcaggagaaagaaataaagggtattcaatcaggaaaagaggaagtccaattgtccctctttgcagatgacatgattgtatatttagaaaaccccatcgtctcagcccaaaatctccttaagctgataagcaacttcagcaaagtctccggatacaaatacaatgtgcaaaaatcacaagcattcttatacaccaataacagacaaacagccaaatcatgagtgaattcccattcacaattgcttcaaagagaataaaatacctaggaatccaacttacaagggatgtgaaggacctcttcaaggagaactacaaaccactgctcaacgaaataaaagaggacacaaacaaatggaagaacattccatgctcatggataggaagaatcaatatcatgaacatggccatactgcccaaggtaatttaaagattcaatgccatccccatcaagctaccaatgcctttcttcacagaattgggaaaaactactttaaagttcatatggaaccaaaaaagagcctgcattgccacgacaatcctaagccgaaagaacaaagctggaggcatcatgctacctgacttcacactatactacaggctacagtaaccaaaacagcatgctactggtaccaaaatagagacatagaccaatggaacagaacagagctctcagaaataacaccacacatctacaaccatctgacctttgacaaacctgacaaaaacaagaaatggggaaaggattccctatttaataaatggtgctgggaaaactggctagccatatgtagaaagctgaaactggatcccttccttatatctgatacaaaaattaattcaagatggattaaagacttaaatgttagacctaaaaccataaaaaccctagaagaaaacctaggcaataccattcaggacataggcatgggcaaggacttcatgactaaaacaccaaaatcaatggcaacaaaagccaaaatagacaaacaggatctaattaaactaaagagcttctgcacagcaaaagaaactaccatcagagtgaacaggcaacctacagaatgggagaaaatttttacaatctacccatctgacaaagggctaatatccagaatctatgaagaacttacacaaatttacaagaaaaaatcaaccccatcaacaagtgggcgatggatatgaacagacacttctcaaaagaagacatttatgcagccaaaagacacatgaaaaaatgctcatcactggccatcagagaaaggcaaatcaaaaccacaatgagataccatctcacaccagttagaatggcgattattaaaaagtcagggaacaacaggtgctggagaggatgtggagaaataagagcgcttttccactgttggtgggactgtaaactagttcaaccattgtggaagacagtgtggctattcctcaaggatctagaacgagaaataccatttgacccagccatcccattactgggcatatacccaaaggattataaatcatgctgctataaagacacatgcacacgtatgtttattgtggcactattcacaatagcaaagacttggaactaacccacatgtccaccaatgatagactgcactaagaaaatgtggcacatatacaccatggagtactatgcagccataaaaaaggatgagttcatgtcctttgtagggacatggatgaaactgggaaccatcattctcagcaaactatcacaaggacagaaaaccaaacactgcatgttctcactcataggtgggaactgaacaatgagaacacttggacacagggtggggaacatcacataccggggcctgtcatggagttgggggcagggggacggatagcattaggagatacacctaatataaatgacgagttaataggtgcagcacaccaacatggcacatgtatacatatgtaacatacctgcactttgtatacatgtaccctagaacttaaagtataataataaaaaaattatattttaagtagagacaggatgtcaccatgttggccaggctggtctcgatctgctgacctcatggtccgccgaccatggcctctcaaagtgctgggattacaggtgtgagctaccatgcctggctgcctgacaacttttcaagactgagagctgcctggtccagagccagggggctgtgacagtcttccagggcagtcccaatttaaaatattctgccttgttgtatcccagtgcaatgaagtatttcttacatagaagcactagaacatacagacttcttaacaacataagcaacaataactactccttctgtaactcttatgagtatcagattttaagcatttttttaaaacaaatttgcagtaaaatatatataaaacatttgccattataacctaagtgctttttatatataggctgagtatcccttattggaagtgctggggaccagcagtattttgcatttaagattttttttttttcagatttggaatacttgcagtattactagttggatattcctaatctgagcatctgaaactcaagatgctccaaggaacatttcattatggtgtcatatcgacactaaaaaatgtttggattttatagcattttggattttggatttctggattagggatgctcaatctgtgtaaactcatttcatcttcacaactaccagttttgcagatgagaaaactgagacacaaaggttatgcaacttgcccaaggttgttcacctgggaagtggcagaaccagggttcagatccagactgtctggcttcagagcccatgttctaagcacaaagccactttggtaaacagaaagaagtccctttgatccctgttagcccatttcaagttgctaactccagggtttctcctggaagtagagttactaaggagagcgggttaggcaggacatgtttaagacggggttgagatccaagggctttcagatttgagtgctcagtcttctacttacgctcccccagttgccaactctccaggtggccgagacagggcagtccctcaggtaacaggggtgaacactggggggctgcgtgcctgggcagttgatggtggtttggtagctgtattcataattctccttcccggtgtaaatctcgctgcacgagacaagcctttgtttgtagccttttccacaggtcactgagcactgcaaagacagggattgagaggagaggttcgagcagttcctgggggcagcccacaataggcccctgacctccacaccaagcgctgaccgtgtgactatgctgcagaaagctcccacttcattagcttatttattcatttcaagtggcaggccctgagcgcacaggagacaggcaaccctacagggtgcctctgggatctggtgcttccactggcatcttctcagcccccactgcaggtggggttgcctcaaaccccttctggaggtttcgaagggaggaggagggggaggtgctccagctgtcattcattcagtttgcatcttcagcccaactgcacaggttggcaaactgctcttttctaaagctatgatgaccaccaaattgggaagggaagaggagacagcagcagctgacccgtgagtcggcattttgagtgtgaaatccaagcactgagccaacggggactctgggactgttttccttccctccgtggtgctgttggctttcctacctgccctccatttaatttctttctcctatctctctccctggctatagattttttttttttttttttgagactgtgtctcactctgttgtccaggctggagtgcagtgacatgatctccgctcaatgaaacctccgtctcccaggttcaagtgattctcatgcctcagcctcccaagtagttgggattacaggtgtgtgccaccacacccagctaggctatagatgttgactggcatgttacctttctgcttttctacctcttgctctatatcacgccctcatctgtactcttttatcctaagtctatggcatttaaacatactctaccaatacagaaatgcagaagaaatacacatcgttatagtgtcccaactttcaacctccttagctaagtttttttttttatcattttctatataaaaaataaaacagagttacaattaatttagttttgatgatatttttaggcaacagcatcaaataactggtcatcttttgtaaatgtgcttcataaacttggggtagagtgccggtattctctagacttacggttcttgggtgagggtgggataaataccccaaaacagtatgccacatgtggtgtgttatgctttttctggggtgagggaccacagctttcatcaattctcaagggcagtgagaagccacagtgtctgctctgccctaatgtctcctgctgcttttagtcacatagttttcttctcctgcaacttttccagggaaaaggctctccttgaagaaatcccagaggcaggagagaacaagtccagctagaggcacgcagagcatccctaggccttcccttccagttggctcgagacatagaaatgctctgtgtacatttcttccttctttggctgctgctgttcaaatgtttgaaggccaagttgacgccaggccaggaaagtgtaaggccagcccggggtgtttcatgcagatggctaacaaactctgtccaagctgtgggtaatcttagtgtctgacccagtgttgcatgcattgacaacagtccatactaacttaaacaaagttgtgcatttgagaggggcaaggaatgagactcttgacccctacaaaccaggagcaaaagtcgtcccctggctatttatgtgggggggagcccagtgggagacaggcatttgctgatggaactgagccccaaatatggtcaggctaaacacagaggcctccacatctctataaagaagctggcaagaacagatgctctcagctagctgatatcagcattgtgaaaatgttgactgctgctggtttcctcaaaccatttcagagagaaactcatactgtagactctgcatgccttggtgtatgtgcttggttccacatgagcacgtattacttttctaaattgaaaataacagcaaagcaaaacaataagactgtgggctccctgcatgagctgtacacttcaggccctgctagaaaatgcatgtgtcaatcaggactgacagagctcttctttgccagtctagctcgggcctccgccaattcaggtggagtagagctcagagaaaaacacacaaagaagcctccaggtaatagaggtcccagagagaaggcatgtcttcttttctagagaggatgctggtgccagtccctttcggcccctctcccctcattgcaggtttccttccctgtggtccctgtatctgtgctaaatactgtttccagccctgtagttgttgcccataaatttgcagacttttcaattcatgatacacctgcaaatttacagaaatgtggaaggcttccttttttcttttcaatcttctccctgtttcatcttttgggggttatggttatattaaagctataggagtaatatgactcaagtcccataataaaagtgctacacaagagataagctaagatgaagatgtcaatcttggccaggtgaaaggtgagatccccctgcgttgggatctggatgggttggaacctatgcctcaaacccaatatcaagaactattctgaacactcatttggattccacatgttcctggctggccaagagcaaatcaatgtcgtaaagatcagaaccatgtctcctcttcactctctaagggcatgcggtactactcagggcataccgagaagatgcagggttggggtcgagcagggtttcccagcctcagcaccactgacatttgggccagataattctgtattgtgagggctgccctgcgcactataggattcttagccccatccctggcctccaccttccaaccctggccagtagggtcccctttccccagctgtcacaaccaaactgtctctagacactgccaaatgtcccctcgaaggacaaaattcacaggaataaaggatagggcgagataattagaaaagactttgggatcagctttagtgcaggaagcaattcaacacccaacacacacatcatctaaatgcaaatattcatctcattaacatgtgaaattgctgcctgtcaaactttgaagagacccagtggcagcaatcatattacctaacaattttcaatacctttactgtgagtccagatgcctccctttcgaatctctaaatgcttttgggcaaatgacaactggtttgactgctacagatctctcatacagatatgaacatattacgatgtttgaaaataatataatcatgctatgattactactggtttattaccattaaaaagggtctagataagcactgtgcacaggaagatatatgaaaaaatggtacttgagatacttcggatattatagaaaattattttcttcctctgaagctgtttgttaaacaggcacaacacatctggttcatgaaaggggtttgtttgccccttacaatgttttaaaaccaaaaatttcagcccccattttcaagttaggaaatctcacatactagtccagatttttagcctctcttgaaaaatcaggtctggtaacgctagaccacatttctgcatggccacagctggagtgaaagagattctgctcccttcacacagcatgtgctagtttgtcacagttgccatctctccttgttgtatccctggcactacagtattttcttatacttaactgtcttcaggcacctcacagcatcctatgagtttgcagcccctgtaataatttcttctttatgccaataggacatcaaggtgaatcacagaatgtagacctgaagggacttagagaccatctcttacatctctcccgctttgcatacaaggaattctagcttgggaaagctgaggacttgtcagaaaacacacagttcacagtggcaaatcgggcgggtagcctcaagtctcccacattcctgcactcatccctccactcatccctctgccactctcaggccatggctgagctgacgatggttacagttcccaggacggtacctctgaccattctcctgtgatccagacatactcgcagggttgcaaactacagctttcacggtccaccggccgcttgctcacgtcacagcgtgccccatgcacctcgtttttgttgtcatccacacacaccaccttgcggtacctggagccttcgccgcaggtcttggtgcactgttaaatacaagcaaaagagaagaataaaccgtagttccttatatcctatgactgtaattatgtgtttacctgtctacatagcctttaagatcataagagccctgagggcagggattgccagagaacttctcgtttttttgtttttttggttttattttttttgagatggagtcttgctctgtctcccaggctggagtgcagtggcacgatcttggctcactgcaagctctgccttccgggttcacgccgttttcctgcctcagcctcccgagtagctgggactacaggcgcccgccaccacgccaggctaattttttgtatttttagtagagacagggtttcacagtattagccaggatgatctcgatctcctgacctcgtgatctgcccacctcggcctcccaaagtgctgggattacaggcgtgagccaccactcccggccgagaactcctcattttaccccagttacctaacaactctgttcctggcattcaccacccagctgtctaaaggaaggaaggaaagtataaatgagtcaatctcagtttagaaaggaccttaaatcctatttacttcaaacacctactcacaagtgacttgatattgacacttatggccaaatgtttaccaagctggtgtctaaatacctccaggatcagggacatcagtaccttcccagatagccatctcatttcataacatggaaccaaacaaatctctttgtatgttccaggcccctgtcctagttttccattccaggaaagcataaaggaaagtttcagctctcacaagtaatctccttcagctatttgaagagggctttcctttagccccaggtgccttttcttctccaggggaactgctctcatgccacatcattctgcaaatattcactaagttcctactaggtgtcaggccctgtgacgggtcctgggtgaacaagagtgcacacaaatggcacattctctgttttcagagaggagcttatatgttagtagcaaaggcagacaacaaagaagatagctaggtagtgagatttaacaattactgtaattccgttttccagatgaagaaaatgggactttgagagcctaagttacttgccccaggtcacacatctctttgtgaggtagacgggacagctatgtttattcccataagccaagggatgattacagagcaagtggtatgtttcattctaggataatctctatgtccacagattcttatttgttttgctttagccaacaccaaaccccacccctgaagtttatccttagtgccctgtgttgctaaaggtcactgaaagcctattgtatctaaagcctctgtgtcacccaacatttcaagactcattgggaagccccagtgagctaagtgaaacctgtaccaaggactgctgcagtttcttaatttaggccagggattgaataccctgttggcaacgggcttatctaacaactgtgatttttgttgtgtggtcagaatgttgtcttttcttttctttcctttttttttttttttgagacaaagtctccctctgttgctcatgttggagtgcagtgatgtgatcacagtttgctatagcctcgacttccctcctacattttagtcccaagtagctgggactacaggcatgagccaccacgctcagcttatttttaaattttttgtagagatgagtctcactacgttgcccagtttggtcttgaactcctgggtttaagggatcctcctgccttggcctcccaaagttctgggattacaggcgtcagccatcatgcccagctagcacactgtcttttaaaatgtctaattttagtctctttacggagaactacagaccccacctctctttttcatctaatgggcagcctttccttttatccctgccttgcctcaaaggcatttatgtttggaactcagcttcactcagaaatgtcttctatgatatgccctatgtctttttttttttggtgataaaatacacaaaatataaaattcaccattttaactatcacaagtatagaattcagtggcctttaggacatttgcaatattatgcaaccatcaccccatctagttccagaatatttcatcactgcaaaaggaagccttgtacccgttcaccagtccctccccattccttccttcctgtagcccctagcaaacaccagtctgctttctgtctctgcagatttgcctattctgggtatttcacatatatggaatcatccaatatgtggcctttattacctgacttctctcccttaatgttttcgaggttcttccatattgcagcatgtatcaatatttcactcctttttaaggctgaataagattctgttgtacggatataccacattttgtttatccattcctcagttgatggacatatgggttgtttctcatttggctattgtaaatagtgctgctatgaacattcatgtacaaatttaaacacctattttccattcttttgggtatatatacctgggagtggaattgctgggtcatatagtatgccccgtgcctttcgtgagctaccctgttcctttaggaaggagaagggatatgctggcatttcctggtagccccttgtcacttgcaaactaaacttaaaatttctgctgcttgggagtaaacctcaatatctagaatatggagtcagtcctcatttttctggagcataaacataacttgaaaccactgtgaggtgagcatggaggagcagaatcatttcaaattagtgcaggaggccggctgagcccagttccctagctcatccctagctcagtggttttggggttctctattcccctagaaaaaaagtgtttttttcatcattaaaaaggtgagatagagggccaccgaatgttaaaaaagaaaagaaaagaaaaatttaatctgtgatgtgtagatatatgcaaatacttaaccacccatagaaaaagtaattccttagaaaattaggacttaggtgactctgagaagatcctaattattgcgcagctaaacctggactaaaccttccagtatcctctcttgttttcactaatccacaaggctttaatctgcatcaataagtaacagttcagagcagaaatacaatgaatcctaaatactttatgcttgttaagcgtttctctctcagtcttaaagaatggttaactactgtaaagactattttgccagcggtggaaaggggagctggaaaaatttaccttgaatataacttttacaaaattaaaaattaaactaagtaaataagtgacttgcccagtgtttcctaaattagtcaacagcagctctgaaaatcacatggcaagggttttctcctggaatcttaaatcctaactagggtatgggggctgggtaatcagaaaacaaatcgagtccatgctatcaggtttcatcagctttttgtaatatggcttccccctcaaccctctacgatttatgactctttcccctgtcctggaatatgatctagaatgttctgaaaaacagttggaaagttcaattagcctcattttaatttccaaaaggttttctctaatttcagtatggcttttagaaaaatctctaacacaagtaacaccaccagcctccttgcatttcatcacacactataattcagaaagaaaataatcacagtgctggactaaatcgggcagctcgcccattgttctgcaagctacatgtgcctttaaatatgctgaaattaacagggggaaaagaacttctccgaatttgagggtgaggaagacctaaagtaaaccctgaaggtggtattttattcagccaggtaggttggccacagagtgatggtctgaaaaggatcatttaatgcaatgggtagaaattttctttgcttaaagattataatcaagttgctttacactttcaaatatatcttttggtgcaattccctaaccatggggggaagaaaaccgcttgagagtcacaggctctaccttttaaggttgttgattttctccatggatgaaagaccttgtcttctctagtgctgggttaccattgttgcacagtgtatggacggcaactcacagaaccacagggttcctgggtttttatgtcatgagaagcagcaatgacaaatcagtttatctagcgttgctttaaatggcaacaacgaaaaaagcagtccttactttaaagctcattttaaagtcaggtatacagaatttagacatttttgctcccaaatagtatatatttgttaggaggtgcggtggggagaaggaggcagaaataatactatggagacactttgtaactttaaagtcattcattcattcaatcaatcagtattttacaatgagccaaggtctatgctggggccccgggaggcagcctccatggcttcgtaccctgtctctctccctgttaggacacccagggtggcagctattcccaacttgggttcccatgtgttagctcagctggctgactggtgacccctggggtttaacacctagggctacctgtgcagttgtgtaagcagttgtgtttgtaacagagcatgtaattgagtaagaagccaccagggagagaagaggaaacacaacggggcaattcccatgatgctgcaaaggtgggcccaggtagcagcagatgagcaggagaatgatggaggacatcagttcaccaggcaaggaggggaagaggacattcttaggaggggctcagcatgcacggtggctggaggtgagaaatggcatgggtggagaagcgggggagcagaatgaccacagcattttggggttttcagagcagattatttgtggtttgggatttttagagcatccctaatgcctaatgcctggaacttcacaagggattgataaacgctggttgaataaattaataaaatgagcaataaagagttcgtatctggctctgtgcgcacatcaaaacctggtcattccctactgttaacttcaggaaaatcttttaaatcaactgaccaaggacctgctgctcatttctaacttttctgtgttaaggagatgcacttggaaatcattctacagctgatcttaataaaagccctcagactccaagtatgtatcagagtggcccaagtccccataccgcaccaaacagcagcgaggtgagcagttctgcaacagtcagacatatctgagcacagcttgtccatggcattgtgagaagaaaataaaacagctgttcttacaggaaaaacagagtttgactgtgcttttatttttttatttttaatgtttttgagacagggtcttgctctgttgcccaggccgtagtgcagtggcctgatgatagctcactgcagcattgacctcctgagcttaagcaatcctctcacttcagcctcccaggtagctggaactacaggtccatgccaccatactcggctaattttttctatcttttgtagagatggagtctcactatgttgcctaggctggtctcaaactctggggctcaatgatcctccctccttggcctcccaaagtgctgggattataggcgtgagccactgtgtccagcctgcttgactgttctaaaagtcattttagaatgcctttattctatagagtgaaagatgaaagtccatcaattagcaggcactgttctatgtttttttccttccttccttccttccttccttccttccttccttcctccctccctttcttccttcctccttccttccttttttgcttccatctttccctccttcctttctccctcctttcctttcttctttccttccacccatccattattttgtttccttcattcattcacagattcattcatttaacaggtatctttgatgttgtaggtaccatgttaaatgatagagaagattctggtgaacaagcttcctgaccttaaataactgataacatagatgagaaaaacaggcaatgagaattccaggtgttaactgccagagtacagtaatctgcgtgtgttgtgagagctgagtggaggagcatctgactcagatttagtggggtggtgtgattggcaaaggcttctgagaggaagtgacatctaggttgaggcctgaaggataagaaagggtgactgaggtgaaggtcagaggaaggtggtcttatgatgaagaggtactacaagagaagagtgtattccaggtaaagggggaaaagaacacatgcaggacctgtgagatctattcctcaatgctgcagatgcatggccccatacgatcacaattcaaatttgaccagaaggacctctgctgctctaagtgaatttatatgtcagattgtgatactattaacaagtaaatcctttgtgataataattctcaaaagaattaaaaagtcttttttaacttttttcttccaaacagcctcatgagcattataattctaaagtgggtaaaactgaccactgcgaggacaaattactcacctgaagctggcgggtgatattagaagcccaacattataaggtgcaggctgagtcaaactgctgtcatcaccagaagcctccatcggaaggccaccgtactaaaaagaagtctactttgggatggcctaaaatgtgctagtcaccatgtcgaatcatgtcatctcaccaaatcctcactgtgacccttgagcaaagtctgccatagaattcccatttggcagatgagctaagtgaagtctagaaattcagagtcaacttttcagagccacacactgaacagaattttgcctacaacatgttgtttctaggatgtaaacaaaatgagatgtggatgtgtggatagagcacttttctcttgtccaattattctaccctatatctgaaagtctgggctctactctcatggtatcaagaaggcccctttcccctgaacaaccaatgggcttcacaatgaacaggaagtccactgaggggctccaacatcatcaagactcgcctggtgacatggcttaaagtctgatagctaactagatcaagaatctcctttttagaaggggtaggtgttacaacccagtaaagggaatacactttgatagcaactctccagtaagaggcttggcaaatcattgagaggaaaataaaataattcactttaggtgtatttggcatcggattagtgaagataatgattcagagtgtaggtgccagcgtgcaagcttccgggcttcaaattccagccatattatttactaaatgcatgatcattgataaattaacctacctaagccgcaagttgcccctattaaatgaggataaaaatataaatactacatcagagagttatggaaagggctaaatgaagcacttcatgtgaaaatactcaacatagtgcctagtttgtagcttagtaaacaataagctttattatttttattatcttcagtattagggccattgtactatacaactctaggggacgctcctcacattgtataaaaatggcatccctcaaagttgtgcagtatacaacctgtgtggctgtacagaacatccctgatgaccatggccatggtgagggtgcagaaactgtgcttctctaggcagatgcttggattatttctcaaaaagaggatggtgccatatcctacggaccaagcatgcaatacaccttgccaacaaactggtgggttttaatagtccacataggggactattaaaaggggaagcaaaaggcaaagtgcatactcaagcaaacaagagttctgaggtggtggccagggaccgctaagaaagaaggggtatcctataatggggggctcctgcacatcccattcagtgggctgagaggctgccctgtggcacactctctgacctcaggtcaagacgtcactaggtgtgggagaaaagtggaaacgtgtgcctgcatcagtggatatcaggtaaaacggtggctgaaagaatggatgtgagaggcggtggcagcaagatcggaggtgagggctgtgatttaggggagcctgaagggttctgtcttatcaagtgaccacccagtttactgttgaacaagggcgcttttgatcataaaagtaggaagaattaataattacatgaggactaccccaggcaaacaggaggcgtggccacccttttcctgatttgatcaattaaggtaattgcccagttactgtcgtccttcacgctcagtcttgctgctttggggacattctgagcaggctgtcagcaggccttgcatgtatgggaaacatgaagacttttggtggggcttctccccacctccagctgccctgggcctcactctgccaatgagaggcctcctgtagaataccataggaatatcataggagatactcctatgatattccgtccactttcaccaccccagtattccttccttagaccctccactttgggtgaaggcagatgagaaagcgtgttcccaggagggtgactattagactctgcttttcctgttactcacagagtcttttctctttgtgagaatggcaaccctctagtaagcttcttaaatagaggcccaggccaggttatctcctgaagccgtctattcttccacagagtttaacaggaatatttgagtaaggtttaaaaaagatccatctgcacgacacatgcaaagaagtaaattttaggcatattgtgcatgatcagagaagaggaatttcctcagtgcatatgtggcaaggtttttccattcttcgggatgcaaaaggaattgtaaacagagtgtgcattttcgtgattggctctagcattttcaaaagctggctaaagcacaagcagtcagcttagattcatttctgaacactctcttactttccgctcctcggagcagggttgagtttagcgtgacacaaagagggagatggagagagcaggccatggtaggtctgaaaaaaagagaatcaagaggtcacactgagggggagagcgagagagatgagggagtctcctcttccttctatatctgacgttgccaatccccaaaccataatagataacactattacctccagttttctcagaacaactctgaaaagttattttatccccattctacaaatggataatccaaggctcagagaaatcaagaatccttgttctaattcccttggctaatgtgtggcagtgctaggatatgaaccaagtctgtagaattttatagtctctagggttccaaataactggtgtggctcaagagctgttaatctgaaatgtaactgctttaggcattcctccctgccactgtctggtgggaataaaaaagtaaagaaggaaaacaggaaaaagactgagtagatggagagggtgagtttcctaaagaaaagaaattactgcaaccaatggaagtaatccatgaggaggcgagggaagaggaagacagggctgggcggctgaatcccaatggggtaaagaatgcagttctagtatttcttaatggtttaagagaacaagcttagcatgaagtcttgcttcttccacttgctaggtgctaggtatgtgacacttggacaaatgacacagattctgtgaacctcagttttttcacctgcaaaatgggatgatgataataataataatgctcaccttgtctggtggttaaaaagattaagggaagcaatgaacaaaaagtacccagcacagtgccaggggtacagtctaactgttctccaaaccataccctttctttatgttctgaaaaactcttcatggtggggaatttcctgccttatttttcattatctctgcacctcaagcagcatgcattttgttttttatgccaacatcagtggatattgttttgctttctaattctttcccccccttttctacagtttaatcttctgttctggaaacagaggttacctcctataaaacctccctggccaaacttttccccatggacacaatgttttccttaaccaaacattaacttgaagccagggaaaaagcaaggcctgtccacttctgcacggaccatcaacggagcagtttcttcagataccatcctttttttttttttttaaatgttagaaatctttcactaattaatcaaggtttcacatgaatgcctatcttctacctgacagccaaagtcatagaaagaggaaaaatacagagtaggttctacctaaagtctgccctgcggctatttaaacagatacagaatgaccaaatctggagacacgtatttaaaatattccttctatctccccctccttctgtgaaagatatctgaatgcattcggcccacagcctgttaaagtttttttttttttttttgaggcggccagacttggaacactcaggaatacagacagacgtaggaattgcttaaaaacaagaagttctcccacccttgttggagcgaatgcgcgagtctgacagtgaaccttttgggaaagagccagcattgtaaccgtgctcggtgacttctctggctttatagggaacagatgtgaggatagcaaggggcgcacacgtgaaatgcctggcaggtacccctttgtggctctacttacttcttgccattcctctgccctccaagtgtagaggggacaccgtgggccttggcagtcgcgttccgactccggtctggtgtatgggttgcactcggtctctctggctattttgtgtgttccgatctgacagcccacatgcctctgctgtacgcctcggccacaggacacagagcactaagaagacagagaacgtaagtgggagcttcggctcatttattttttgggggggcggggggtgtcgagggtcacagaggaggggaatgcactcctaatccaatgactttcatagctatcacatcgctttctaatttgcaatgaaagggatcctagatcatgtcttaaacctggaaactcactgcttatcttatccacgctggagagtgaggaaggtgctcaagtttggaggaatccctcaagttaatgtaattcttagaggattgaagaggttaataaaaatcattatgaatcatttagcacaacctggaaatagtgctgccatgagaaatgaaaacttgaaatgatttctatcctggaggatttgagactcatgaaaactggagagacagtgttgtacaagaagaatttcttggcagattaaaaatataacccaaggagaagtaaaccactgaagattttaggactttataagtagaattattttctccagtctcttccttttcttgctcctattcatggagataaggcgatatttttttaaccacagaattcactaaagaatttgtgtctatttacaacctcagatgaatatatgaagaataaaagctgacaggaaaaaccatttcctcgggcttaatgttttcagcccttgaaaaatattgttaatcatgttgaaacattttgctgaccaacttgcaaaacaccatattaaatctgcaattaactttcctctaaattaattttttaatggtttcctcattgctgggtttcataatctcacttatggccaggccaagaattattgtcttgattaaggttttgacagccagaaactaaaggcaacatttggaaagaatggtatattattacacttagctattaaaaattatttccaaatttttgtgatagctcagcctccattttttggtctggtgttgagaaaataagcttaacatacattaaagccatattcctaagaggaagtcttcttaaataatagaatcatgacctttcaaacttgaaaaaattattttccaattaacctgtagcaacattcaactttctttgagactattaatggaaatttactatcaagaatcacacccaaatgtattctgctgaatggtaattttctctccatttcagattttaagaaaacaggtaacgatatttagaaggtaacttgagaaatcatactgtttcagataaatctatgccagagaggagaaccatatgttcacatcaaagctagctgaacagaagaaaatattttggatcaacatagctactattgtttgggctcaattgtattaattggattgaatgagtttgtgacccacaagaaaccagacttttaaagtcattatgtcctgggtgtaatgggaggattcctgaacacaagtgatgaccctatctatagagaatggccatttaatgctcattagagctacatgaataatatttcccattgattacactggaaaagaatgtactgtaacatgatagagttaccccataaatgatggacatgttcaaatattatcatcatcaataaacaacaaccaaaaagtcttttgactatttcaatttggggtcttaaatataaaagagcacgtttctggaacaatatatccaaatacaaatacagaaagaatattgtaaacaaatttgagtttggtataggactcaactatatgcagaatctcataatgttttaataacctaaagaaaaatgaaaacatatttaaagacttttagaatgtataagactattcaggctactaaataaatgaaacctctttttgaagctattgtaattgaaaaaattacttatggttcaacgaaggcacggtactaagagccataagtatccaacatttaaaaaatcacttcctacaatgtttgataatttttcaaaagacaaattaagacacaggaaagttcaattatacgatatgtcattctggcttctgattttcatgatgcaaagccagctttgaaataccacattcaaaagtttctacatgacttaagtgctcacagcaaggtacaagcctgcctttctgaataatgcattcacagtaatctttgctcaaaatgaggtccactccatcggagttagttttctgtgttcaacttttcttcctgtgctatctcaagggaggcaacagtttgcatagagagccagccaggcttgcttggaattctgagagatttgtgcaggcaccccatgaataaaacagcagcagaaagacctctgtgtgaccccggaggcagtgatggtggtggtatgtgtatgtgtgtgtaaatccaagttttcttgttctgttcagtacaccttttagttcgtttgcagatgaaaacatctgaatggcctctattaatgtgctccccccacagccatcatcccaccaccacagtctattcgtgcaggtttcaaagtagacgtttttcactctgaactcctgagctgggagctatgtttcatctctctctactccccactgtgcaatgctagtatgcagaactcaccaacttaaaaggggaacttgatgcttatttccatagagagaaagaatctccattgaacttttgatgtttagggaatcataatatatacttgaaaacctagaaatagttttatatactttcttccaggattactgctgaaattatggtgatgacattaaagcagcgattagtttgaaaaacaactatataaaccaacttttataagtaacaataatagcaataataacacaaacttttactaaacacttactatatgctagggtttctatactagcatacagtatatgctagtatactgaggtttctcaattaaataattcttttttgtgtgtggggggggcgttgtcgtgtgcattgtagaaagtttagcagcatacctggtttgtaactaccagatgctagttcccccttattcccccccaacttgtgacaaaactgtctctagacattcccaaatgtcccatggggtacaaaatcacccccatttgaaagcttagctctaggctaagcattttacataaaatacctctgatacttcccaataaaccttttaggcagatacttcataaataaataaaacaaaaaaacagagataatcacccgaactcaagcaaaaacaaaaccaaaaacacaaagtaaaatttgtcttagacaaggtagcatagctactgcgaatgtgcgtttgcgatcccagtttttaaattggtgctaatatgatgcagtcttttgtagcaggtcagtgagggtgtgggtgagaggcctgtcttcaaacaattcaataccaatgctcatgcttcaaatacaaacaaaataaatggaaagcacaaaatactaaagcaactctagttctcctcactgaccatgtgcatatggcttccttaatttctcaaagaacacaagccacacatttgccacatttctccattaaacacttgaaggacacttcagaatgacatcacaatacagctgctctaattataattataagaaaagtcttaatcaagaatggatggtagattccatttcagcattagcactggagatcttttaaaaattgatgcttatttcattgaatgtaagacaacactgattgcaaaacacaccattatattttgtagcactaagaaagacaacaagggctgttaaggaaatcatgacattgcatagtttgtgaagcccatcctgaccacaaaggtgttgaactgtgaagaagatctgcatctcagaactgatgaatgacttgattgcatgaattcatgattgattaatgcattggtgtgttaccttcattctaatctgataatttattctttttatttttgatctttattttaaaaactctatagcgataggataagttaaaaaagttttactgtgaaacgctttttgtatcatgggaatattgagtcttcacatttgtcagtctgaatcaagaacttgatgctaatttttgtcgtaaaagttcataggcattccttagctcttgattaaaaatatctaaacaaatgaaatgtaatctttttggagagagaaaaaccctttaaggcttcagtaagaataattccacccctccttcaagaaaagctgattttctttacaaattcaagatttcagaagacacagaagtgaaatattccactttaaatctcaaaacatcaatactagcagagaaactgtaaagattagcatggctattgtagtttctatccgaatatcctatatatcatattatcatcagacctttcgatgtgatgagaaattaaaccaattatttttcctaccttgaagacaggatgactaggctgtaactaccagcagaaaacagaaagaccagatataaaatcttctaaatattgctgcaagtggacaatcattactcttgcttactatcacagtcttagggatattcttgtttaccactggatcattaggaagccaataatctttaatcatgcagaccgtctttctccattaaccactgggtctgattattttcaggtacacttctaaattgcccaaattgaattttacccatgcagtactttgtcttgcctgcttttcttatttatttctacaaatcaaatcaggacattataaggctggccacagaccattatataactgtgtttacttgcattttctacaaaggtgacttgacttttccgagcaatcattttgaacaggtgcagtttattctggggaggcattctgataatcctattaccttatgttggcaaaaacccccagggtttaaacctaatcatttcagctttgtaagcaattttaggcttcccatcaagatcacatgatgctggattaaaactcactctgtgtttaccaataaagagcaaaagattcttttaattatcctttgtgaatattggcttttaacatgagcatcatttatatgctctgaacttaattaatattcagaggtaaataaaacagataagtagaggccaaggaacattaaaaaaaaaagtaacagatcatgaaagtccacaagagacaagctaattagcgtggtatcttaaataatgctagctgcaagcttttacatgaatcgaatagctccaaaaaaaaaaagggatggaagttaacagatgacaaggatcacttagaaaaacattaagaaggatgactggtatgaaatattgccttgaatatgctccccgaaggaaggcaaaggaggaaccagctctggctgggtatagattttttttttattgttaaattaaaacaaacaaaacccccatgtttcattatgataaaggccttgagaggcatgaggccactgccctgaggaatgatgactggaggatatggagggcagtgatgccagatcagggcattgaaaatacattcaggtttctgaaggaattttccattagtcatattgaaatggaggattctcgaatcctccccacattaatgtacgctatgaccaaagctgctttggggccttaagaatcaagattctaggctctggaagaatccatgctagagcccgccaaccttgaacctagattcccatcgattatctggagtcatctgaatgattctccactgcatggaagcaccggaaatacagtaaaacttcattgattcagatcagtggagagaaggagcagcattaaatacagaatgttttaaaagaaattgagccttattacttttaagttagcaccttcaaccaaactaagaaaatgtgcaagtgtggagttaccagatctactctaaggatttgatatgaacggctttagttcacatatccagtgtttagagattaaacagaagcttctaaggttcctgtttcaagttcaatagggaaactcacacccagttcctgactagcttatgaaatgtttagaattagtggagtctaactgtaatcagtgtcttgggtactcacacccttctccatcccatacacacatcacacttgtccaaacaaaatataactcttgagagcctactagattgaagacccctgcaaagcgctgggcattcatgattgcattaaatcgtcataagagccatgtgtagtaggctcaggaaaattaaattacccaaggtcatatagctagaaaataacagagaactctctcttctgtccttcaccttttgtaagcaagcaaatgggcagaggtattttctagaactttcgtcaacagccctttcttcaagaacctccaagataaactgagactcaatttctgccaggtgaccacagtcagcttcagtgcagtctgagttagtagttttctatgtggtgataatgcaatgccatcagtgaagtattgaggggctgacctgtgctccatctgatccctatttccacttagaattcaccctcacagccacccctaattataggtattatccaaagctccagaggctggagcccaatgtcacacagctagtaagtatcctgactatctaggtaatgattctcccctcccagtccccgagctcccctcggtaaaaccaaaaccgtgcatagaaacacaagtgaacacactggggtcagccacgtggccaaacgtaaggaagcagtcagtagaggagaagcattgctcacctgactccaagcgccagctttccatttggggcatcttcctcctcggcactttctgtgcccatgtggcttagccaggtgcttacagtaatcactttctaaatggcttccatcttttgccatgcagtaaacatttcgttgtttatgccctcgaccacaagagacagaacactgcaatataaagcaatggcaaggttgttgttgttttttaattacacggagtttgagaaaaaacctgcgtcttgagatgttaagacaatgcctaacaagagttaccattcccctcttttacagcgccagtttggataatatctcaaggcttaatagggaaggaaggtggcattgaaaaaaaaaatgtccacagcattacagcagcaatcctgtgtggcatttttggctcactcaagagtgtgggtaaatcctgagaattggagccaaaaataaagctcatgaacctgaaattaccatgaaattctgattttaagaagtcctactatgaaatagtgatatatttcttcaacaaaatgcctgtgattcactgactgggataaaggtgcatttccaaaatacaactatgttcaatttcttaattaaatgatttaagaataaaactcttgaaccattttccagaggataagctctcgttttcccagtccactgggaagaggtgaaaaaggcacgttagaaactgaaaggtaagctagcaggtaagtctgtgccaattttgggagggaggcattacctttcaactttgatctgcagattcactggactgttttaaatgtgaccttgtctgaccacatctgagaaacttgactttgatttcagattaggtttctcagaaaggtttaggaatcaaagtgcccatggagtcgggacaaaaatttgatatgacagcttcttgtaaaacaggcaagaggctggccccagtgagtgtgctgagatatgcaatgtccattgcctcattagtgattacagaagtcattaccactcagatcataagctgctggctcgggttttcaagacacattatttcccaatataatggtcttgctttttagagggaaatgaatttaagaatgaagaacaaaatgtgaaaacgcaatgaaaacagatttcaagtgtcatttccttctattcaatatttatttcccccactaactttgtgattttgttaaattaccaacatgcccttttatgcctaataaatagcaccatgtgaaacatgtaactcatgaaacatattaactcaaccactattaccaagcatgctcagttatccattcataaatgtaccagacatgtttttctagtaaacacaaaccactataaaaagttcaatagttgctcatagagaaatgtgaagtacgtatattaatacatttggctttaatttttttaactttaggaggtgaaaatattgctgttttcatttgagctctaatcttatgaatattatgatttggagtagtcattctgaaaatcttaatggagtatacaggatggaaggaagccatccaacttgaaatatctataccaaaacaaaaatattcatcattcaacctgtagtgtttgatctatataaagactttgcgatataattctagaaggcttttagaatgaagttcctagaagtatctccacaaatctctagaagtatgctgatgacttgcacacagataatccctattaatagtgaccaattttaatattttaaaacatttctctgaaaagaaaataatataagggttcaattagatttggaatgaattcatttatttattcgacaaacatttatagagcacctacaatgttccagaaattatgcaaagtactagaaatgtagcgataaacaaaattgacaagtctctgtcttcatggagcttacagaccagtgagggaagctgacattaattaagtgatgacaaaaataaatatatgattattcattgaggtaagtactaggaaacaaacaggctggaatggttggaagagggctcactgaggtacttcctggggtcaggcagcaaagctatgagctacaattatgagtttggattttattctgcacaagatgaaaaatcactgaagagtttcaagtcagagtaagacatggtctgatttttgtttcaaaacatttactttgcctgagtagagcccaagtgggaaaacagtgtgagtggaaatgagaaagtcactcaggaatgcttaggtaggggaagttgggaggctgaggcaggagaatggtgtgaacccgggaggcagagcttgcagtgagccaagacagcgccactgtactccagcctgggcgaaagagcaagactccgtctcaaaaaaaaaaaaaaaaaaaaaaaaaaagatgtatttttttgaagtagaaatgatggatctactctagggtggagaggaaagggcagtatcagggataactttcaggtttctggtttgggcaattgggtagatagtgataacacttacagagatggggaaaactgggagatacagcattgggagtcaaagatatatttatttctaggaaatgagttgaacttaaaggatatagaatcatgggtggtaaaatttgcttgactagggtgaagaaacatagttgtgtcagagtaatcaaatgaacatgggtgaccttaacacaagtctatatgtagggacagtcacttcaatatacaaatagtccaaacaagctgtctcttaatatataagggaaaagagagttgttagaaatattaatttagtaatctactgtggtcatcagaagttacagcctaaaagttggcaacaacctgtagaggaagaattggaaaaggtacaactctctcacatttatgagccaggcactgccctaagactttatatgcatcatctaatttaatcatcccaataacccagtgaaactcagtaatagagataggtactattagtggagacaattggtgttttcagaatggcataaccacaatgctttatatagtgcttcccacatgacttcaacacaaatgaatacatttctgttggaaacaataacagcacagtgaaaaatagttaaattatcaccaacctcactgataaaaattcatctgaggtataactgacatctattgctaatggaatgaagatgaatgaagtagcttctaaatacaatgccttatcttttcactatctggactagctgtaacctacccattccagggttttgtttttgtttttaaatttggggacttgactggaattgacttggaaaaaacaatgcagcacttgccatacttattatctgcctaatattgttaagatctaaaggcaattaggaaattctcaaggtatctaatctgatagcaaatactcttcttttaatgctttctaacttaccaatgaagaaaagcagctgctcgtggaaatgttcaaatctaacaggtttattaatgggcctactatgacctgatagaggggctatcattttgataatcaaataaacacaagtttcagctcttacattctgagggaaatttccatcagatcatttccagtcctttctcaggcactgacttttacatcaccatgtgtcactgagacataatcgtcaaatttagtgtgtcacctagtacgtgctatttattggttacacatctgatagttcttgctctagggaatatttaattcctcaaattcacagccaaaaagcctcctactttgccaataggactctgacttttttttcttgggaaacaacccaactttgtgtaacagaatgatcttcctcccaactttgagcaagactcccagacaatgtaatctctgtttgttacttagcagcaccaaggtcagcatcccaagtgcctgggtattcaggcttttgtttctgttgggtggcttgaaggggatgttgaaatgtggtgttttgttcagagattgtgttaacacttttcactaattaaggtctaagagcttgaaatccttgcatttcaattcatctggtggaaaggaaactcaagacatgggccgtctgttcttaacctctatcgagggctctctctcaagaagtagcactggatatggtgcagacgaatatgggtttggtgtgctgtctctggttttagggatgccccacattggtcctttcacttatacagaggaacgtggtttcttagttattgagaagccagaaaacagccctggtgtgtctgcctgaatgagaagggctggagaactaaagagaatgggatccctggggttgctgaggctgccaaggacctggacatccaaaacaagatggatttctacacagagttgctaaagataccataaagaaccaagaaggaataagaaggggaaggtagaggtcagagatgtacacaggatctggccagaaagaggcttctgggtggggctggaagatgcaggggcttagaaaaagcaggggcggccgggtgcggtggctcacgcctgtaatcccaggactttgggaggccgaggcaggcggatcacaaggtcaagagatcaggaccattctagccaacatggtgaaaccccatctctactaaaaatacaaaaattagctgggcatggtggcatgcacctgtagttccagctactcaggaggctgaggaaggagaatcgcttgaacctgggaggtggaggttgcagtgagtcaagatcctccactgcactccagcctggcgacggagtgagtgagactccatcttaaaaaaaaaaaaaaaaaaaatggaaaaagaaaaaaagaaaaggcaggggcttagaaaaagcactagaaggggactgaatgaggaccaggactgcctgagttatagcagatgcctgctatgcaaggactaatgcatgggccagggggacagccctagcacagtgtctgggcacagttctatgtatctaggtgattcccattcccaagtggtctggattgatgagattctgtatacatgaaatatgaaatgggggtgctgaccaactagtccatatttccaaccacaggactggctgatagcaggtgagaaataacaagcactgaaaggccaagataaatgtcatatacgagaacctattaccaagttgtcaaggctcttctgatctaaggatttttgacaacagatggctaaccattactcagataggtgttttgagacaggagactgaaggaattactattcaaggcctttcccttgtgagtctacagactatgaaaataacatctaaatcacttcatttaaaaaatattcagttgtatcttttcatacaacaacaaactcttcttgattccactctccttttaactttaacaaaacataaaatcacagctcatctggaaagtatgtcatcagaaaggatgcaacgcatatgcccaaggttcaggactgcctttgccaatgacagtgacaaatgaagtgaatactgcatgagcgtcacactgttgggggaggcaaaggagatgccagcctgtacctactattccactgaagaaagaccataaacacaaggatatagatttagtgatcaaagtttcaaacattgctcagtggaaggcctggaaaaccatgtggggcttaccacatggaaaaaagatagtagctgcaactcatacatgtttacttgctgctttccacactgtagtcagtcagcaaatatttatggaaatgaatgaacatatgaaaactatagccatcacagaggtgtactataaaccaatgccatgtttttgtaaaggccggaatgaaagaaccacctggaatccgactcatggtgctaatactgaactcatttggcacaagttatttagattcaaaaaggccaccccaagagcactctctttcagtttgagcagaactcctgaaaatcatactagctacctttcattgtgttcttattatgagcaggatattgggataaagaacactggtttctctcatttaattccaacagcagtctggtggctcaggagctattaggattttttttgtatcgataaggagactgagggtcaaagaggtgacgtcacttgcccagggtcatagcaccaggaagcaggagagttaggctttacatacagcatggctggtcactctggctcatgactttaatgccagaattttgggaggcagaggtgggaggatcacttgaacccaggagtttgagactggcctgggcaacatgacaagaccccatctctacaaaaaaaaaaaaaaaaaagaaaaattagctgggcatggtgatgcacagctgttgttccaactgcttgggcaactgagttaggagcattgattgagcctaggggtttggggttagtgagctatgactgtgctactgcactccagcctggttgacagggcaagacacacacacaccgcccccctccccacacacacaccccaaccactttaatccttaagctacactggaaaaatggcctggttaagacaaccagttgctcacctctacttacccatggcaacaacagaaagcaaggacctcaggaaatgtctcttaagacttttagagttgcctgattcctcagtctcccacgaagagagtagctacgcaatgttaatagctctgactttaatgccttttctcacaacacctttagtgcctgtgaagaaagacactataaaaagcaaacatacaatcccataaataaagggccacatttccccttgactgaagctaccctacttttctcttggacatttttcagggtttattaactcgttgaggcctgccagatgccacatagtagattactatttccattgatgggtgaatgctctttacacggtcaagaagggaaggctgcaggttgtaaattttggccccctggcaattcaccaaggaaaaatctcttgaatgctcaatctgcagggcatctcaaagattattctgtccatctatttattttacaaattcaagactagagaaaaggagagatgttgtgcccaaggtcacacagcagggaaggagaaaatgcaggctgaagaatcttctgtccctagcacagaatgctatttggctcccgtcgcaatgggggcctggggctaggttatggtgttgttcaaaaaccacagctaaccacacactctgattctttctcacccctaagcaagagtgtaacaacctcttgttccaaagcaccagcaaagagcaaattccaaggggtgcttgggtgctgccaacacaggaaatggcagctggggtggtggggagggtgcttgtcttcattttgctttaaaatgttgcaaaggtttgagagtcagacaggcctgggctggaatcctaccctacctgtcattttaccaaggtgccactaggggcaagtgacttcatctctcagctcagatttgttctctgtaagatgggagaatagtagtaactgtacccaatatcactgtgttacaattaaatgagacaatgcatgcaaagctctttgtgtttcagccagacagcatacaaatggtacattttttttgcatcattactactattatttctattcagtggacccttttagaatatctcttaacacgaagtttaaaaggtgagtttaaaaaaattttgttaactaatggagtctaacattctaacagaggcattgataggtaaaggtgggactttggcaagatctcatccctgtgaatgggcaaagtgcttttctttccaaagttcccagagaaatcaatccacagagcagttatatacgttgaagattccttctgtagtgcccttttctctcttagagactattacttaccagtattgtctcttctcaccagagtaaggagaggaaagatgctgtatctgaatgccacatcccttttctactccatcattccctgcttacacttaggttttctcaagaactcctgcgtttctcccttgtcttttgttatgccatttctttaaatgtcctgagccacagaagcagcgtcaatgataaccattacagaatccacagtcactcacttccctgccacgccctgctctgctgtgagagttgtcacagtcctttgtcaaaaaacacatctccttattggcaatgaactcactcaggggaggttttacaggcttctcacaaaacaagaatggctctgaacagtggcagcgacaaccaaaatattgaggaaaaatggagagaaagctttaccaggaaacaagggctgtgacttcagggcgtaaagccagtgttgacaaggcctgcctgatggctgtttatgtctgggaccaccctggcacttattaccatgaaaaggagctgagagcgcctgagattggcagggaacaccaaggaagaaagcggatgtgggagtcacggtcatcccagccggatggggcattaggccatcctcccatccccactgccccccaacactccagcctttgcaacgctacaaaggtctaagaaaaggaaccaagattcacatgtcaactcttggagcacagtcgaaggctgctgtcaatatgagaaccaagtaggtggccctgcatatgcttagtaagggagatggcagggccaggcaaataaagggagacaacgaggggctcacatcttccactcccaccccaacgcccccaggaatatgggggacagggcgctccagttccccaaccttcgatctcacaatgtaacaacttcatattagaggggaaaataaattttaacattaaatatagcagtatatgaaatcagttatgcaagctatgaaacccaaattagggctctttttgttctccaagagtggaaatattttaccgttgtctttcccatcaagaaagaaacaaaaaccaaggaaatctgcaaatgtagcacctggtgaattctatcgtggctatatccaggagtaccctggggaactgatgacaataatcaccaggcagtgttacccctcatgtgggtaacagggctctattagcctgttgattccttattcccaaacacattgcctgtttttgtaggacttcttttccctttcaaggtttaccgggtgattatttgtaacctgacatcagcagaataatgatgttcacatttttcaagaaagaggcgaagataatacaaggacccactctatgcctgccatgggattatttatgaaagccgtctggaagacagggagggcggtgggtgagaaatttgttccagaggtgagtgaagttgtgtctgagtaagtaattggtgggaaagctatgactggtaggaacagtgaccaaagtttcttggtactctcaaggtggactgtgattgaaggcctggactggagagttcaaggctacctggagatgtcagtctgctaggagatgacagtgctggggcagacccacttgacatgacttatgctactgtcaaaagcagtcaggggacagagctggaaagcttcagccaccttctgaaatgcttctgtagagaagtgatccatgtacctaaccaatatctgccccttggatcttgttctcttcccaaagaactatctatgtgtcaacaagtcatttaaaagacaccaggacacagttaattcagttgcttcctccagtcttactttctctgcctgtctggcccttcttctgtaagctcattgtgaaaggagcatctttacaggccagcatgtcaggtagactatcctgaaaattttataacattttcgggaagcagcttatgtaattaatttacttgtgggtggatattaatgccaactccagaactaagatttgcatacgtgtctgagcctgtatccagagaaatgtatctcagcagcagggataaaggtcattttaaccattatcaaattagatgctcatcctccaatttagcattgctctatcgggaggttggacagcacacagtcactctcaatatgcattattcaagtcctttgtggcttttcttgtctcctcttcctgccttcctttggttaaaaaaaaaaaaaggctcaaaagtaccactatgaaaggacgggatgagcagtaataaccagataaaatgtaaatggctcacaacacagaagacttggcattgaaaaaggctaaaattacatttgatggttttctgcaaattcaaatgattcctacactactctgagatgtattcagatggaaatcaaaagattgaggcagaagggtgtagtggctatgaatacggtgttaggacagtcagacctggtctgactggaaatatctttctttgttatttttggcaggatgcttaaccactgcaaacatctatattcaattctgtttaacagagatatgaagtgatgacgcctacacatctcaaacttaacatgttcaaaacagaagtcctgctcttcctccacaaatctgttcttcctgtaggcttccccattttaatcggtggcaactccatcctttcacttgtccagtccataaaacgggagtcattgtgacccctttctgactcttgcaccccatagtcaactctcagctaatcctttggcactatctcaaaaattcttccaaatcctaccactccttaccacttcccttgtgaccactgtcatctgagcaatgctttctctcatctgagttactacaatggtcttaccacttccatgtgtgttcctcctgtaccctctgctaaatccagaagccagagtcaacctttaaaaacaaattcatgttcctgcttagtgcctccacccacgttttcactgccagtcccttcctatctcaaagtgaaaacaaaaactccgtccaataggctaaccctccttcctctacttgcccaacagtctgcctccatgttcgtctccctcagtttcatctgtaatttcctatcctatcattcacatcctctgttctagccacattagtctctttggtatcactaagagatgcctggtgtactcccgctttcaggccttaacctgtaatactcttctcccagatacttacatggcttccttttgtattttcccctatgtttgctcaaatgtcactttcttaatggagacttccctaaacctccttttaattaatttaattaagctctaatttaatttaatctaattctcacctactcttctacgctatctcctatccttcttccctaatttatttttatctatggcaactgccgtcttctttcataatatatatttgacttttttgttttgtttgtgattcgtagcttgtctccactctccactagaaggtaagcgtaatgagttcaaaggtttttgtgtgttttttttcactcctatatccaaaatgcctagaatggtacctggtttataaaaaacactcaaacatttatggaatgtccaaatgaatgcatgaaacaagtgaataaataatatccaatagaacctagaaccacttatctcacaagaataaagattaagtaaacattctgcacaatgctcagtttattgttagaaccaaataaataacaattgctgtctcctgtctcttatatccattcagtccaaaactagccacatattcttgtggtttaatatttaactcatatctacagaactaaatgcacaggcgacatctaaagggaacattatctgagaatatcatataaaagaagccgacaagaggcagaagctaggaactcagaatactacactgccctgtaaatgcaagaaacattgacagtgcattcttagccactgatcccaccacataccctgcgtgtcatataatgttgtttcctctccctgaagatgtcatcttagagtgacatttttgtcagatgggtgcaaaaatgtatgtgtgtgtatatatatatgaaaaacagaatacaatgaaatgcaatactcaagaatgggttttatccaggccaggtattttctttcttttggctggaaacatctaaaagcataaaactgaagattcactcttctgttccaaaacaatgtgtctcagtgatcctgatcaatttttttaataagttttctttcatttagaaaaagccttgctttctaagtataggatatccaggactctaaaaccaataccgagcccaagattttgtaaagtgaatttgatagaatgaaatcatagccaccctcctgcaaactctctacagccagtccccacgaagtctaactcttatggagagtactttttacccaaatatgaggatcaggccgtgtccagaaagaccaaattttcttagctcagtaggacctttccttacaaatgtactaattctcatcattttaggatgctgtaaaagtccagggggaaactgatccatttcaaagctctggcctgaggttgctgggtgacccagtccaaatttgagtttctttgaaagccattcaaaactaagtgaaatgtaaaaaaagatcctattcagaaatgcaaatattcagctatctctgacttgtgataagtaaaataaacaaaatcaggaatctggctaaaaacccttgggaaacattcagattccaaggacccagtcccagggacttttataaagcaaaagagggctgaactggtttctattcaggcttgtttcttttatgcatcacaaaccaaaattcatgtttctagaagttttgaaagctccccaagagaggcagtggaaaaacatggggctttggagtccatcaggtctggatccaataattactgactgtataattattgggaacctttcttaacttccctaaatctcagttttcctgtccgcacgatagacatcataagacctattttgcaaggattataagaggattggcaataatgcacacaaaggacctggtcaaggccagggctcacatcagatgtttaataaatgagggcctttgttattattttccacttctagtcaaatccatttggccaattgcaaatgggcacctatatgtgccacatcaggaaatgtaagacaattaattgtccatcagttggtaactactgaagtggagaaggtcattcattcagagcagtgagctttttggtggtggtggtgtgtctttgtttaggggcaatttttctttttaaaaaaatttttaatttcatttaaaattttaatctatttatttatttatttagagaccaggttgtgagactggctaatttttgtatttttggtagagatgggatttcaccacgttgccaaggctggtctcgaactcctgggctcaagcaaaccacctgccttgggcttcccaaagtgagtcaccatgcctggccaagatttctcattttttagggattctttcctaggcaaaacatttgcatgtgctcaatttatagcctagaattaccggtaagattacagttaggcaaaagtcaaaattcaatttctaattttaaagggcttttcacatagccaattggtaatttaaggttccaattaattctgaaagacagcatccacttcccttatggaaaaccaagatctcttccacattgggcaccagtgcataagtctgttctttaatacatatttctgtggtcttccatcaaataaagtttgaacattgcagggaaaatccaatgtttcattagagtgtaggtcccaccataaaatttctgaggttgatgacagtctcttgggtttattttctttgcctttcctctaccaatagatttcttctccagtctcaaagctttggagtcactactagtgtttatggccattgttaatgacctttttaaaggaaaagaattgagattgattttccttctgggaccaagacatatcatctaaaatgttttctgaccctctgatctcagagttgtacctgccgttttgagtgtgtttgtgtggcatgggggttggggttgggaaatatatagcatttgccatctgctagaggagcaaagatttgcagagtggaaaagaggaggtgcgaggaggtagaactgcagaaacttgcttccccagaagttcatgtataggaaagccaagttaatgccacatatttggaaaaggtgatcccctatgtatagttttctctgataggttttttaaaaacccagacaaagtggaaatgtctgactatgaaaacttggtgatctctacaatataaggatttcacttccctttgaggaggaagggaatgattttataacctcagacttctctgacttaacaaatagggacttagtatcaaatatgtctggtaaatgctgatgttctacctctctaatgcccataggaatatggaaagagaaattctgctgtgagaaattcatagaactacctggcagaaaaggaagggtgatattgcctcccagggaacatttggcaacgtctgaagatatttttcactgtcacaaccgagggggtatgctattggcatccagtaggtagaggtcaaggatgctgataagcatctacaatgtcccaaacagtccctacaacaaaaaattatctggccccaaatatgaatagtgccaaggttgggaaacccttcttcatacctattcacaatccatggaacactttatgtactgctgtcttagtccctaatcagaaattatcaggtaaaatgctcactagaattaatcctacttccagaagagttctcaaaagagaaacctatatactcaactctgatgctcaagtctgaccaatccctagatactgctgacctattcatatattcatattctatcactgatatgggaagctctgtttgaaacataaacttaaaaaggaatctctatatatgaactatcagtgctatcagacaatgctaacattatgaacatgatgaggatataacccttgttttcttagaaatgcccacccacatttatgctgtttttagtttattactcttgtcaaagttgccatgcagaatgtctgttggtcagttgggcacatctgcacacatttacaatatctgccacctcttttaaccctcaaccccgccccacaaaatgagtgatggtgcttgttgatttgcagattcacagtctggtgagacaagtttgagatctcatattttcagctcatccttgaaaacctttcttcgatttgactgaccttgatggctccctggaatctcacctacattttatgggaaattcaactctccagagagaagagctttcagatagctgcgggacttgcaactgtgactttcagctttcgcttttgaatgaggctccaaatgtctcaatggtggcactatttccagatttggggtaagccaattctttgttgttggggttgtgctgtgcattgtagactattaagcagcattcctggcctctacccactagatgcccatagcacctgcatccccattgtaacaaccaaaactgtctccagacattgccaaatgtccaccgcaggctaaaatcacctcccaattgagaactattgaattatactaaggttctcagaaagtccttcagcaagttctcaaaactgaattgattcaaattgacttggtgaggtcagggcacacagagattctttgttgatgggagttgtaaagggcctgctgaacatccgctcaatgaagtcaggggctccagctaaaagggttaggaagcccccatctatagaaaacgtgccgtgtacaacgtgaaatcaattcccatgcacaacaatgaagatcccaattacaatgaacaaacacgttcttctgaacagaacttcctccctgacattatgtccatgaccctgcaccctgcggggggctcggatatgttacgtctgattcaaagacaaccaaaaagaaggaaataatgatttcaccaagaaaggacacataccaaggcaggaataggtaagtgggctaggtggggcttttattaatctcaaggaaaacaaacagcacacatttttgggaaaatgctttcattttcaaaggaatctggatgtggactggatagcagtcgattaagaaaaggcagagtctgcatatggccagatatttactggaatttactaggaagagatgcaataaaagtctagattcccctgggaaaagggaagcaaaaaaaatgcaccattctcagaggcctttcagtttagctgcatgggtgggatggggaggagggaggaggagagaaggcttaggaaagagaaaatcatgggaaaaggccaataaaaaagtaggaaagattctgtttctgctgagctctgccacaccccactcccttttttatcacattacagtgcaaatctcagattaaaaacagcttcctagaatgtgtcagaatttttaaagttgtgaaataaatccagatctactctttacttccttgtgaaggaaaaaacacactctgaatacatttgtttctttaagaaattttataaagtaacttattttgaaaattttccaacttatagaaagattgcaagaacatcataaagatctcccttatcccctcatcctgagtccccaattgccaacatttcaccacatttgctccccccatctctctctctatatgctattattattttgtctttccctgaaaaatttgagagtaatttagagacataacatcccatcatctctaaaactcttttttcctcaaatcaaggacactcttttatgtaaataccgtacaactctctaagtcaggatatcatcattattaatacaacagcactaaataatcctatgcctttctttttaatgattcccttctaccagttagctctttacttccatatttctgggctaatgtaataaggagttcagcacctgagtagctgagctcattcattcatttcaacattgtttatagtatgcctagtttgagagaggcacccagtttgaactgtgggtttcattaggcagaaggaaattcaggtatggggcaattaaataaatgattggggaaacaggtttttcacttaaaatgtgttggctctgtctatatttcttcctctgtcctagctaagaaaaaggaagcaaacacagtctgctttttccctgttgtatttccctctgttcatcttaccaagttcccaagcgtaactgttttattattcacctgccacatggactaaggaatacagaggtagttgtgagaatgaggggtgatgagaggaagaggatgcaagaacagggttcaaggtggttgactgtcttaccaatgggaatgaataagacagctttgctaaaagaagagttcagctcctatagcttaattttagctcaataaatagtttggaagacgttccaatgcattgaatatgctttatttcaaccagagagttacggtgagatcacattttagtaaattttaccatttttcataattcacttgtaagtgctacagcatcttaccttctgcaaggaacctcatcaccatgaacagatgtaaagtcacctgactggctctaataaaatctatcatcctgactatctatatatctactaaataaagaaaatacctcaagttattccatttctactaaaaatgccagagatagcacccaatatgtgcttaatactggttgcttttttcttaaaatcttctgaaaaccccaaatcttgctcttttacttggtttgagacaattttcttatattcattcctgattttctttgcttatcccctaagcaaaacttgtaaatggctcaattagcttcagaacatttcaaatattaatagttacactctgggataacataaaatcctacattgtagacataccctttccactcatgttacattttaccatttcatcaactaaacaatgagatgaggggattatatcttggcttaaaccactagcttaaaattcagaaaatcctaaattcaaatcctggttcagccacttcccagcagtgagacctagagaccactactgagcagtgagatcaactaagcaacttctctgatggtgctgacttcatcatgtagagaggattaagttagacaaacgtgggtgaattgtttagcataattctgagcacaaagtaaatgttccaaaatgtaagtggttgttataataaaaaaaaaatcaaagtcctccctataattatgggaggaaacacattgtgtgacaaattaagtggggaaaaaaatctgctcctttgtggataactgaagctatcaattcattcactgtctgagatatttcagaagaaaatggcttagggagaatcatttgaactatttctcattttagtgcatagtcaacctgagagtgagcatagtagattaatcagtgcttctaaaaacagaccatctgtcagattataatttaattcaggatgttgccctaaacggggggaaaacactctatctggccactgaggaagagaactgatggcaattatcagtcaatttgcagtcaatgttgttgcataagtttaaatttcttggggccctcagtatagagtaaaaatgtaaatgaataagaggtttttttctttttgacactgtagacattaagttttgcaaaattaaatgactacatttacagtcatggaggagagacattgcctcaactcggtttcttctgatgtgtctttgaaacagagccctgcaaagctaatctgctcaaccttcacctactgggttcaatgaatatgaaaagctgccttcctgaaacttttccttcaaagagggaatgatctcctggaattcaagcttctacaaggtggctacctggtgttttccacttttgccgtctcctaaaaagcatcattcaagccttgccctttcaacccactgaacacataaacatgctttctccttaactgaacttatggccacgatgaacttgaactctgagattcacagaggagagtttgttttaacagctgcttttacaatgaagccctggagttactactctcaagacccctggttctgataggccatcttttcactgtcctctgcattttctaatgcccagctgtcaaggaacacccactgaagttttccaaaacaaaggcacgaaacacaagaaaggcaagagaatgctaatcaccagatgcatgggcatcctatgggggaaccccttacatgtggaatacggtttttctccccaatttatttttataaatttattgatttctttgctagtttgttattaattgttagagatgtcctgttgcctgaggttgccctgtccgatatggtagccaccagcgacaggtagctatttagagtaatttaaaaattacattaaaaatgcagtttccttgtcacttaaccatgtttcaagtgctcagtattaaccacatgtgactagtggcttccataaaggaaggcaaaaatagagaacatttacatcgctgcagaaagctactagatttttttggccaaggcataagctctttctcataagagaaaggggatgcagatcttgctaagagtgatggatttctgggttcagcctacatgagtcatcttccatactacccctggacatgctttccttggctgccaattttctattttataaatttcaggaaagagagattatggttgttaaaaccattcatgacaatgatcccactttagagaaaacaacagcaacaagcaaagaagatggtgtggagatccgcacattccacatcttttaattggtacccattaaataacaaagggaaaaagtaccctcagaccacaactctccaccttgtgtggaggccaaggacccagcagggagaaggcagaagattaggttctccactcatcctggctctcagaccactgaactcacatttgggttctaatggaatggtgattggaagcatattctccaataggaggtttttaaaagttctgtgccatcagccaggcagcatctgtcatttaaaatgactggccagttgcacgtttaaaagcaaagataaaattgctaatttatacttactgaataaacatcagcagtatccatgaaggtacctaccctaatagcaagttgtatttttatttttatggtggtggcgaagctgccaggaaaaccaaagcatcagttctttaattacatttgtttagtattgatttaatactaaaatttctcttgctcccttagaacaaagagctctaacttgtacactgctgtatccttagcacctggaacagtccctggcctacaataggcacttagaaagtatttgttaaaaattgattttttttttttaaagaaacaacccagagtttttttattctgccccaacccccaacccctggcattaaaataaatcttcctcaactgccatcactaatcgccaggattccctcctagccaattatgcttggactcaacctctacctcccactccacattccaaagtttctatttctttccattccagaagggcaactccacaacaggagtgagggagaggacctggactcctcctcagagtccaataacactcctaaccctgctcccccaacctgtggactttttaaatccatgaaaatagaacctgtcaagctaccacaaaatagcatcagaaggcaggatcagtctttcataggcatacaatctctgtaaatactgaaaaaagattattaaaagcctgctaagttttgtctccagtgaaatagatgcaggcaagtattttgattgttctgaacacattagagatgagtgctacacagaactaaggtaaactttgtaaattcgtatgtcataacactttgttccacaaaaaactatcttattttttatactccatactgatacagccaaataatgtggctcttattttctaaagatgccagcaatatgtttaaacatgtcttcattgtagtaaaagtatcatatttataaaaaatacatatgcatttaatgtgatattccttatagtcaaaatcttgatatcatcctgttaatctggctaaaaatgtatctgtaaaatgaaagagaggaatattttgccattccctaaacaacagttgtttgaagcttttgtaattgctggttatgggaatttaccaataacaggaatgaatttggattttcttttgctggaatcaaatggacaatgtcataattagctaaataatgttgaggctaaatgaagtttgagttttaggcacatcctttatggaatataaacaggaacctaaaagttcattctgaacataggttgtttctttctgccaaaacaagattaatagtcagtaccctaacgacaaggtcctatcactgaagtagattatcggctagtcaaatgggttcctaacagcacctccctcatgggttaaaacaagagggttaatgtgatgtgtatttgcttaatttggcttgttatacagtaaacacacagcaaacgttagctattgttatcttcatttcctttggagaagttatcttatttctcaccttattaaaaataaaccctaactcatacagggaccctccttaccttggtcctttcacccatgaataccataataacctatactgcaaaaaggaggctcaggaggaggatgaggtatcaataggcctccgggtcatttttatgatttaggtattttttgaaaagggtaggctctcttgaaacttccaaggtagttgttgtagtattttattttcctttcataagaaatgctttctgaaatgtattgcagtgaacaaataacaaaattgacaaatgctgtaagccttttacagttatctgaacacacagaataaagtgtaatcaaatttgtgcacattaggtttgctttttcctgtacctagctgtctcttatgtgttcagaaccatttcttccaatcacctttttttgtcttctggctataatttatcattatctacaaattcaataaatggagcatgcatatttcatagttgagattcaataattcaggacaacagtactagaaaagaaaaaatacccaacaaaatattaagcctcatatatttttgtttataaatctaagcatcatttccaactcagaaatatgtttttaaagtatccctttaaaatacatacttgaagctgtctaattacacaaagctagatacttggctactcagatttgagggaggggttgtacaggttggagggaatttacaaaattaaaatgtatctttttaaaaccaaaagaaacatatacattcatttctaatccacagagcctacttgcctttacagtctgctgataaacactgattttttaaacattgtatataaaattaaataacatgaaaaaataaatatgctttattatataacacatagaaatctgtactgctcaaaatattcagaaaattctaggtgtggctgcttaaaactgtgtttagaaaatatggtagtgatatttacaatctttatttcttctagggagagaagcagtgaggttataaaatactggtatcaaacattttctcttcctacctacagaagctgcaaactttaatacgaaaatgaggtagacaaaaattcataagttagccaggcagaaacaaaagcacaattccttcatgagctcataaattctcattacttgggtcgacaagcattattccaatgcacctaaagcaaggctcagagaacatttttaggtttgtcatgaaaaacccgaacaagcaatttctcctaaggagaagcacagtttccaaggtgatcagcaagcaggttgacagggcaatgcacaaaggaacaccgaagacccatcttggatacatggtatcacctagcagacttttaatctgtgattatctagatgaattagctttctctagaacgctctggatttttagcctactttctgctgtggttcgatagtatagaggtctctttccaatttactcctcaagtcataggacatatgcatagactacttaatgtcctcctgggactgactgcaggagtcaactgaaaggcatgtgagtttaagaaccttatttcaggctgggcatggtggctcatgtctgtaatctcagaactttgtgaggccaaggcagcggatcacctgaagtcatgagtttgaaaccagcctggccaacatggcgaaaccccgtctctactaaaaatacaaaaattagccaggtgtggtggtgggcacctataatcccggctacttgggaggctgaggcatgagaatcacttgaacccgggaggaggaggttgcagtgagccgagatcgcaccactgcactccagcctgggcaacagagcaacactctgtctcaaaaaaaaaaaggaaccttatttcaaaaacaaacactaccaaaaaaagagtccaaaggcccattttaaaaaggatagaaaaggttgaatttctggaggatatttctcaccatcatgattcttaaatccgcaatgacttgagccagaaccaatggctgatctaagatggggacttaaaccctaggttcacagaagcttcattttagggatgctggaagctatattaatagtgatttggggtttctttcctaaatactgctctttagtaacaagtgttgaagtaggcaatctccattttgaccttggagaaggctaattcacacagcagcagttgcttcttgacatcatctaatgcatgggagtactgggagagagaaagcaaccaggcagaaggattaattgctacccttggtccctaataaatctaagttgctttctgttgaaagcaacatgttagcacctccaacatactttttattgttgttagtttcaccgtcagttacaatgatgaagcaccatggaagtggctttatggctattaacacaattactgaggtatgcttacatttggaattactaagatattataccaaagcatccacagaaataaacacacaattaaaatcaaaactctacagtaagaatctgaaagactgccctctcactcatatatttaggaaaagtaatatattacaaagatattttaaagaaaatgcttttgatttaattttttaagatcacaattaaaagccttgcagaagtggccttgctcttagactgtagaggcttcgcatatttgaataatgatcactttataaagaaaccattgaaatcatataggcagcaaaatgattttaaaaatgcgtgcacttgcttctgtgcatactagagcattataatttctttctctctctctctttcttcctctgtttcagagaactgtgtgcaggcccaaggagaacaactacatgaaataaaccttatgttttcagttacaataattagcagttcatgttttaaaatttaaacatttatgctcttaaaatatctgtgggggagggtagtgatcctgtgtaaaaaaaaatttagcgtatttagaaagtgtttaaggaagagaataccatggaaattaatttataattctctaagacttatgtttttccccctgttttcccaaataattcttcctggagaggtaaatatagaataatcaatggaactgagatgatcaatggaattgagtctgggaagggaaatgcaggtttctttttttcaccaaaccacaagaatatgcaataaatagccttgtgtgtttcttcctaagggttaagagatttttttttttttgggtcaaagttaatgaactacgactttgtggacagctagtagactttctaaaacataactctggtactggtattgctgttggtctagtgaactgggtgaaaacacaatgagcttaagagggaatttcacgaaaaataatatataataggagatgagggaagttgggaatgtcagaagatgttcctgagattctaaggttatttctgatcttcaaaaatgttcatctggggaaggtgccattattgtagggaaaatgctcctactgaactgactagagatacaacagaccagagctctctgacccagagtggcgtttcttaagttctggaagaaaatacttaacagtccagctaaatagtaccagtggagataatgctccaaattcttctagatttctgcctaatacaaagtatagtgattatatagttagtgttacacctgcagacacgaccccagccattgaaacccttgactcttagaaatgtcaacaggtattaaccatgtcacttcacttaatctgctctttagctggtttcagggatggttaagacttctgagaaccatactgggtaaaaaaacattctggatatgacttaatacaatactaaattcagcttcagtgcaattaatgtatttacaggaccatttttcctctatttacatgaaacagccctaacggctccacagcttatgggcacaactcagccaaagtattgttttgacacagctgatgcttctgtttgccaagagctgccccagaagtttgcatcatatttacagtggcaaacctgtctcaccatgtcagctgctggctaagcagatagcaaaggaagactaggaccaaagcaaaaaatggtcccaaacgggcttcctatctctgtgcaagagagagaacatttccgacaccctaaaaggcaccaggtcacctgttccatttttggtcttttgcatttttaaatgattttagtctattttgtgggcacagactttgtaaaaattatgttcagagctgtacccgagtcacacaggcaaattacagtcactgaagaaaaattgctttggcctcagtaagcaggtatctttcccaaaaagtcaaaactactacagcttagaaaaggaaagaatgtgtgctattgagttgtctgttaaaatcactatgtatgtgtgtgtgtatgatgtgtgtgtgtgtgtgtgtgtgtgtgtgtgtgtgtgtgtgtatttaggctaagaaaaggcagctacttcttggcaccaggtcctgtatgaggtacacttattctttaaagtcactttggcaatatcataaaaagttaattctattatgtgccaatatggagaaaataatagactatttatagcagagtttctgggatgcccttgtaagtgtgacaattatctgccacagaggagtgccccagaataccttggaattagatagtttggttaacaaacatgaatagttagggccgtaccgagctccaagggccagtactccatgcagcgtcgtgtggacaagcatgtgtgttacactgctcacgatcgggaggtttatcaagaatttcacagctcaaatctggaaaccgttcaccgttggaccgctgacagaccaccagtcttgttcttatgcctccaccacacagcttagtgcactggaagaaggaaaaggaaggctgcagttattttgtctgaaaggccaatgacaaatttcctttctccctaatttcttagccaaactcaattatggcattgggcaaggtaagcctctgacagatggaaccaaggtgaattaccaatagtgatacgtaaaacagaccaagactctcctactttaatggcaggtattagttattaagtgctttctcttaacttgcactgaggacttttgcatatattatctaatcaagaggagtgtaattatttgccccatcttatatatgaagcaattaaggtgaagggaggttaattaactcgatcaagtccaatctgttagcaagtaacaaagatcctttctttttttttgagacggagtcttgctctgtcatccaggctggaatgcagtggcacgatctcggctcactgcaacctccgcctcccaggttcaagtgattctcctgtctcagcttcccgagtagctgggactacaggcgtgtgccatcacactcggctaatttttttgtatttttagtagagatggggtttcaccgtgttagccaggatggtctcgatctcctgagctcatgatcctcccacctcggcctcccaacaaagattctttgagaaataccaaaccaaaccaaaacaaaacaaaaatagacaaacaaaaactacccaataccaaacaaaggagacaatgacttaactggttctattttctggcaaattttaagaagctgtcaccaatccttggctgttctctgactccgtctccatagccctttatgacactaacctattttactgtatctctgaatgtgaggacaactatgactttccccttggatgaataaacagcatggtgggaacactggataaggttctgactcctggctagatctaaacttctgaggcaggaacacgttgtatttcttggacagtgctgctgcgctcaaatccagcaacactgacatttggtttccctgctgtgtcaaggccagatctcccacagaatttggaatgatctggtctgtgctgacagcaaagcatcccagcaagttcgtgtactctcctggcttgaatccaattacagaagcttaatcacaggccccacaggacagaactttgcgaggaggttttgggaaatccacaatacatgagtcacaaagcctcattcccttttctttcccttcaacaaagctctccagaatgacataactgtcaatgaaagtcaacaataatcccgttatgactgcctatgactactaggttatatggctgaaaccatgaaatgtggacacgtgatttcattcagccaaggatgtggactaacatgcccatcaatctcatttgtctttttcccccccttggcactgggacctccaaagtgttatttctcgtgttttatttgataaatgttatagtcaagacagaacaactcaacaaactttaaatatgtgctctccctgtggattcaagaatagagagatatattcttagttaattaaacacaaaacaataagcatctaggccctatgtataataagggctcaaacccccacttagtcacagtattattaataattattcttaacattaattattactacattatagtggcagttaattgattaaaggcgatgtgctacgcatttgatagatactacctcatatcatggtcataaatactaagaagttggtgctattactatccttatttacagatgaggatataaatatttggcaaagatactacattatttgccaaggtcacaaaacttttaagagccagagctgagaacaggacacggttttctcagcttccaatactcagttgtcccctatcagtcgtcacaggcaaccctgaaaaggtagcagctaaataattccatatttgagaaaacacagctaactactcacttctgcaataaaaatacatcatctttcataggaattataacacctactcaatctggcttcattagtgacttggaatgttgggagacattatgccatgggaacagggcataacacaaacaccccaaaactatgaagaagagggcaagacttccatggaccgatttaacacatattttcaatcactttaaaagcatctattttttaatcatcagaggtgaacaaataacttaaaccagtatttatctgtattctcacctaattttcctcacctgtgtacccaaactgtctcttagtggtaataggaacactttaaaatagtccagaatttaagaagacaggtttcctagttaatccccaccccagaagcttctactagagctagttcttctccttgaaaataaaatctgaatgataaatacagtttggttaacacaattcctctgtatttatagacggatagttcactctcacctctccccagttgccataagcccactgaggacaagggccggattcacaggctctttgctcatcaggttttattctctccacacagtcgtttgcggtgtatccattttcatcctgacatacaacaacacgccgctgggatccgccagcacaggtactggaacactaaacacatcagtcgacaagttaatccccacctcaatctccatcttagggacacagaagcagctggttgaaaggttaagacaaatgtgctgaaaagcattctcaagtcatccacgaaggacaaaaagcaatcaggaaaacccaagaacttccccactgtggggctgtttcatgtacacatcctatagacacacctggagggcagaaatgtgtcttctcttctggtgtgcctcaggccctctacaggggttccataaatgcctaatgtgacttccaaagcaggccacttactgtctttatcccctctgcatctctaagaggtacagaggtgttgatggacacgacagttaatttggaaattcttttcaaaacttcaagtgcctatttagaaccaatatttgattttcctttcaacgcggaggtcaaattacatgcctaatgaattgccagttgtagaaattaagcttctgtatgaactccttcaattactccaggaaaacatcatggaatgtcatttagacatcatttcctagcagataaaatgttcctttctctctctttacaacagcctgaacttcggtggctaatggtagtaagacttgttttatttattttttacttccccaatgaacttaattgaatttcatcatgacaaacctctcttcggccgtgctttcagcctaacaccctctctttcatggtttgtcatggggttatgtttgcatttcatttcatttcccatacaagcctctcatagttcacttatttacacctgaagtgttttcttctttccataacttctttatctttttaaacccaaaatgtttgctagtgtcctttaccccgacccttgtaaaatcagtttgcctataaaataatcatctggtcctcaaagcaatgtatttctcacgatttatcaagactcaaactgcatttgcaagtatgttgttagttccaggttctgaaggctgatttttgctttctagctaatcgtagctcatatcagtgttatttcaagataggctctatcaaacattgcttcttgctggtcatcttcttccgtatcaagatgtgaatacattttgttgctaattgaactggaccactgttaatttccctgcccatgctggtcaaattataagtgtttttaaatcagtatctacactttcattttatattgggtttacttttttaatgtagagctggataatagatttattagttcctcttgagaaaatatttaggtatttttcaagttataaaaatgttacctctatctttgatgattctggtatacttactctaaatctcaaaatattcatttcctattttttttttttttttgaggtggggttttgctctgtcacccaggctagaacacagtggtgcgatcacaggttactacggcctcaacctctcagctcaagcaatcttcccacctcagtctcctgcatagctggagaccgttggtgtacactaccacacctgggtaaatttttaaaatttttcgtagagacaaggtctcactatgttgccccaactggtctcgaactcttggcctcaagcaatcctcctgtcttagcctcccaaaatgctgggattacaggggtgagccaccatgcctggccttacttcctaccttcctacttttaagcagcttagtacataataaaaaacagagaactattattttaattagctttgtttggggaccagaattttaaatgttaggaagggcctttcatggtataaatagatttgtcatctatatcttggtcctcgagttttctccttgataatataatcttgtatcattcctttattatgtcacctgtcagctttattgccccagtaaaatggcaggctccttgaggaaaggctcaatgttttaacctgtgtccctattaccttccatagtgctggtcacaggatttgctacctggtccagttaaagattctggaagaaacagctctagaaactccatggtattctctctccaatatgtctgatgggtgcaaggatgaacacctgatccatggtcaagcaatccactggccacccagggagtgactggatgcttcctaccgagaatccaactgaagtgctggtgatagctctcagcttgggccaagcagttgcactgcacattcttgagctatctgaatcctgagcctgcttgggtctttatactcccacagacagatgaagtattgtacataacctttctccaggtctaattttgccattatttgattaacagggattcttagttccatttctccatgttgcagactttcagtctggacttttgttaacaaagtccctgtcctctttaaatgacaacattttcttaggtaaacatttatttgaacaaactttgaatctattagtaaaacgtacttgaaatttgtcatccacaatggacaaaataaaggagaatggcctttagagaagcaaagggagacagatatttgtttttttctacctgctcaaatcaacatccttttccttacatctggcagcccaatttcctttaagaaaacattcctcctcatggcagatgccatcttcatctatcaattaagacactctgccctattgtggtcagaggtgggcaactggactttcctgggaatttgaatcctcagcagaataactcaagagtggcaaaggcttaaaagagattcattaagacagaaactctctaaagaaattatcccttagttacccctctatctagatcaagggttggcaagccacagcccaaagaccaaatgtgtgcggccacctgtttttagaaataaggttttattggaacagagccatgtgcacttatttacatattgtctatgcctgcttttgtgctgcaacacacagctgattagctgtgacagagactgtatggttcacacagctgaaaagatttattatctggccctctgcagacaaaacttgccagcccctgagacagagccctgaagatgctctggtccctgtccctactgcggctaaatgaacagctttgtttgtttttctttcacttgagtcagtttctgttcttttttttttttttttttttgcaaaactcctaattgctaacacaccttgctcaagtgtatacagaaatctattataaaatgaagttcttactccagaaaccactgaaaaacttgattcccattccccagtgtttataaccctttgccgccttttctgccatggaaggcaggaagaccatgtacagtttgtgtaccatgcaatgcaatgcaaagatgacgtacatccttcatcttcctgggagcaggtcagacacgtcaagctagggctgaaaatcacattgtccagcttcagcctcacttaacgtaggggaaaaaatatccaaacaaaaaacaggcacaatgaggaaaagaatggtattacccatcgccacaaaaagcttacctaatcctccctaattgggagctctgcccaagggcagaatcattcaatcttaaaggaatgcatcatccccaaatgtagtcctaaataagcacagcactaaaacactttctttaaatcctagcgctatcattagactacacatgtgtgagttttgaattttgtcaacaaggaaaaaccatgagacactcggtgattacttccttggatcaccttttactttctcagaactgaaatctcttctaatctaggcaaaggaagcccaaaagtggaaagcaagagagggggatgggatagcgagggtcttgggcaacttggcagctgttctgcacacaaccagcaaagacagtgggtgcaaatgctcagtggctaattagtattcatcagaaagtacgtctaatttactgaaacataaccgcagtgggaaacagacagcttccttctaattctttttagcccagaaacaattaaacagaattagcagtactagaaggaaactaatagtaaacaattaaaaagaagacccctgaataattagtaaacacctaactacgtccctacccaggatcctttaaaaccctccccctcctgcagttccatttaacatgtctggtattgcacagcatatttttttttaattatttagtaaaaacttcaaaacattccaaagcatacttttcctttgatatcagatatttgtcaaggcctccctaatttgaaggacaatgataatgataataataaagacaactgtcgacatttattaagttctcactctgtggcaggcggggcgcaaagcactttatctgcatcatcttatttaattcttacagcaacccaagaaagcaggaattattgttatcctcattttacagataagaaaactgaggctcaaagaggagaagggacctgcagaaggtccccaaatttagaagtgtaagtcattggatcaaacctacgcatcttccctcagagattgtgctgataaccttaaggttagagtacttctctcctaagcacaaatcttacctagtctagtatttccccctaatccaggacaatgacctactactacaaattacacagcaaccatgccactttgagactgcacccttctggaaaatagtagaggggaaagtgactttcattaagaattccctttcagaaaagtttctctgtcttcttaattcccctacaggtatgagctgcctgtggcctccaggatgaatcctgatggtatttacggtacctccaggaggccatgtgatcatatcacctagccatgatatcccctttctccacccaatcgagacagcttataggtggacgcaggcagtatcagtatcatcaagggctgtaattaacccattacaagttactcaaagcaaatgaaaatgcacaatgtcaatcccttgtaaagaaaaaaatatgctctaaaggtgtttctagtctcttttaccctaaacccaacctcaagtgaaagagaagcaagcaaacttcagggaatactcactgctccccaggggccagttctccactggtttccaccgagcacatgggtgcggctggggctggcgctccggggacgatagtcctcattttggaaggggtgctgagctaagccactgtctggggtcctttgagggcatggtgacatggaacagtcctggtcagtttctgggatataatcctggtcacactcactccgatcgatcacgtggtcactgtagttgacacacatcacttgccgggttgccctaccttgcccacaggtcacagagcactaggttgaatgttcagaaagagaaagggtcagtcatttggtggaggggttgacaattcctgaatgtgcatttctgtaaatggcccaccactttcccaaattgctcaggccaaaaaccttggaatcacccttgtctcctctttttttcccatcccatatccatttcagtgagaaatctgtcagctcagtattcaaaatcacaaaatataaccctttacaacaaaagtcaaatcctatccttccttccagtgattttccaactcatttgaataatacccaaaatccttacattgatctactagaccctttatgatgtggccactgactacccctttgacccatctaccattcgccactcactgcactccagctatgctggccttactgatgcttcctgaacaagccaagaacacttccatctgagggacttcatacctactgcaccttttgctgtaccacttaaattcccatgtgtgtcattccctcacttcattcaggtcctgctcaatgtcaggccttttttgaccaccctctctaaaagcacatcccatctttctctattccacttctcctcttgacctctttctaggacttatcagtacctcttgctatattacatacttccttatttgttcattgactggatcatccattggaataatctccatgaaggtaggggctttattattcattcttcactgctctttctctagcaagctttcacaaatatctggtgagtaggcagatggatcttagagaagatgaactgacggatggacagatggatgaatggatgcatggataagtgtttggaagctcaagacatgagagtgagattatctactatttattgagtagtactttctgctaagcatttgacgtacataatctcaaataatcctcacaacagccctgtaaagtagtattcttttccgtcttctttaagagcagagcacactgagactcatggacttaaaccacattgctcaaggccatgcaacaagtaaatgccaaggtctgggtttttacagagctctgtttcattgcacctctcaaatttctctctctatattatgatatttattgagatattaatctccattcttcttatgccctctcctcacctatactaatgtatttcttgaactctgggctttttgcagggcagaaaacaagaagctgcctaaagataaaagttctacttgtaaaaaaacccatagatagtgcttggtgtacagcaggcaggttcacagcactggatgaggattcccacttcccattcttgtcaggggaaaccaagagccacttgatttttagggaccacaggatgcaggaggaatctagactcagagtaagagcctctcccctcactctcctgacatttttggtcctctacaaacctactgcatactaatatgactcagtgaagactgggatttctgatcagcccaacaggacagacactcaagcagactgtaaaccgatttatccattttttgaaatgtgcattccttaaacatttagctaagagtccttgcacacttggccaactacacataagtggagcagcacaatttaaatcataagacaaatccagctctgaaatattacccattgacatttccaagtggcgcccccctccgctgactcctcatagccctcaatgtttcccccattccccctaattccaaataatccactggcttacagagctccagtccaaggccttccattgcccacagggtgtcacagaacattcttcctttgccactggtctaggcagggtagcacaggcactctcgtcagccacagagccattctcatctcggcagctgacgtatctcatccgggtacctttcccacaagtggctgagcactgggtgttggagtaaaatcatgcagttatattacgtggaatggctgcttactggacagtagcccactttctatagccatgtctgagaatgttagcccccatcctgccctccccatttctcccagtctatttcttactggggtccaagacccaaatcgccactgggttcttggtgcactgtatgtgcttctcctcgtttccggggcagctgggggaggatgacatgatggtaattcacagtcctagacgtgatgggggaaaaaaaaacaaagtcactttcaagtcaatgcactttcaaggtaatggtcatggtggataaaaatgtaaaggctaagaattctaaggcttcagatttctgtgtgaatctgggcaagtcacatgacatctctcagtcccaatgtcttcaactgcaaaatgagatataatcttagtccttttgtgggtgccttaataaagggcaggggtcagcttgaggatttttaaagccatatttattcatccgtttgtgtaaaaagagaaaaaatattgtaaaaggacatgtaagtcatgaaatagcaggatatcattttaaaatcattagttgttaacgttttaaaactctgaaggccaaatgatgttctcacatttcaattaatttcttaatcagaatttgctaatcatgaacttgctttccctgtttgcccaaagataacatcagaatcccagaatgtcaaatgtagatataaaaggtgtattcaattggccaatgcctggacttcatataacacccctcaatcatgcagacgaagtccctgttatgaactgaggtcatctgcgtacaggtaatattccaagatatgcaaacaggaacaaaagtacacacctgctcatattcactctcagcctcagtggttaaaaattatcctgtgacttaatacatattcatcaaatgcctgagtgtgctgtacacagtgcaaaagtgctgaggcttggtgtcacatatgactgagacatctttgccttagaaaatctatgtgtggaatgtgaaattttgttacgtggctccagactttgcctattcctctgtttttggtccaaagaaagccaccgggaactttttacaaagtgaaggaattattcacatactgcaatggtgggagccatcccatagtcaaatggatataatagaataacttaaagggaaatatattttgaatctgaaagggagcagccaagtcctcagttcatgattgctttagatgccatagctaacattttccaggcattcatcatttggaacatttcaataaaataatatattttttattataagtcacatatgttggttaattgatcgatgatgacaacatgaacagcactgccatattaatttatttttttaacactctttatccattaacaacacactttgaaaggcagcagattgagggtgttcaggatggagatagtacatcagccacatggggcttcactcagagtgtgagttctgggaatagcctgggttcaaatgccatcttcagcaattagcaaagctgctatgcaaacccgagtgttctctttatgtattctctttacatacatgatgccaaaatcaaggcccatatagaatagtatgctggtgagtggttatccaccagcttcttgagaaaaaagatgtgtgtgtgtttatagatattttgtgtacacaaacacacacatattacatgcatgtacatacacatacatatgtacatatatgcttatttattataaattttactgatataaaggaggtatagcaattttgaaataacaataaaatatacaattatatattttaaattccatacagccaactgattctcacagaatacatttgttgatttttgctgaacttttgaacctgttgcccacctatgtttgtaattgccaaatgagcgtagttcaggcatgaatgttagttgatattttctttatgtttaagggtaggatgaaagtggaatgatgaagatgtatggccagaacttgactcactgaccagtgatgtggaagatgtctttgctgaatcagatacctttcagatattagaagaatatttccacatccttttgttctattcacaatgtaactgctacagacacaagactcgtttacatttaatctgcatcattaacattttctccattactttcttaagtctaaccaatcaaccaaataataaattaagccctgaattgtagcccttgctgattcctgtggtgtaaatactctcatcatggccattttcaagctatgaacttgatgtcaatgaacacagagctggggagagataggtggcagcacacccttacatagtacatccaccatacagacacatacgtacattgtataagttaagttctgagtgtttataaactttgcttttaataccctacatttaattatagatttatattttcagtttttagtaatggttatacttaataatcagtttgcaaaactcctgcaaaatttatcaattggctcttgtgagctggtacaagttagctccagcaaatcaccgcctgaacatgtgacactagttactgaatactacattgaaatcattttagaaatatgagtttaagaaaatgagcccaaaacccaacattcatcatccaataggaatcaaaagcaaatctacatatacttcaaataaccagagaagaacaaaactgacacaagatatttgattataaatgtaacatacaggtaaatctggacaaattaatctactggttgctctactgacatacttatctatgaaaggatttcaattttgtctaaacagctgggcagtttggtaccttggtccccaaagtcaataactgagttggacaaaggaaacttacctgggtatcagttggtctagttgctgcattacagtcattgtcatctaccactgacatataagtcccaatgatgcatttcactgctcttagctggtatccctgtccacaagtgacactgcactggaagaaggaggacaaaaggtatatacaattcagcaaatcttctctttcccttactttccccataacattctgcaagagagaaatacttccatcacagtaggccagagggctggcgctcaaataaactaggtcgaagtgggcaatcctgctctgtacaaattatactgattcattattatgatgacccttggaattatttctgcctcccattgaaatgatatttataggggttcaactcattaactgtgaactcctagaaggagcagactgcatctccatcatttttacatctttcacactacctagcagagtgctgtggctaaaataggtacttaatagagctctgtgactttatttgacttctaggaaattatcctgaagaaataactggagtttgcatcaatatttttataagagacaaaaaaactggacaccaccaaagtatgcaacaaccaaaagttcaatatcacagcatacaggtagttaggaaaataatgtagccactaaaaggcaaaatgttagattataaaaagcagactaaaaacagtaagtagaggaagtgatgccacagaaatggcagactagggagctccaagaattggtccctccactgaagcaactgttaagctggcaaaaactggaatcaactttttggaactgtggaatttaaacaaaaccttgcagaaactaggtgaatgcttaataaaaaaagaagccactcaattttggcatttctgattacccacctaccacactacatattcctctcaaacgtgcagggatcttttttaaagagagaccatacgttaggctgcaaaacaagtctcaatatgttttaaaagaatgagatcccacaagcacaatggagtgaggcaagaaatcggtaatagaagaaaaactagaaaattcacaaatatgtgaaaactgaactacatattcttaacccataggtcaaaacagaaatcataagggatattagaaaatactttgagataaattaaaatgaaagcagaatataagaaaatttgtgagatgcaatgaaagcaatgttcacaggaaatctatagttgcaaacacctacactaataaagaaaaaaaaaaaatgaagaaagatctcaaatccacaacctaactttacttcctaaggaactacaaaattaacagcaaactaaaaccaaaaaaaaaaaaaaaaaacaagaaaaggaaggaaataataaagattagaatggagataaatgaaatacagagtagaagaataatagaaaaaaatcaacagaaccagaaattgattttttgaaaagatcaacaaaattgataaacctttagctagcacgactaagaaaaaatgagaaaagactccaattactgaatatcagaaatgaaggagggaacatgtctactgaccttacagcaataaaagtgatgccaatatattagagaatctagataaaacatgccaacttacgcagattgcctagaaacagacaaatcacaaaaactgactcaagaagaaataaaaaatatgaacggacatataagaagtaaaatgactgaatcattaatcaaagtcttcctcaaaaagtttgtaccagttcactcatgaattttaccaaacatttaaataaacattaataccaatccctttcaaatgctttcagaaaaaaaaaaatcaaagaataggagaacacatcctaacttattctatgaggccagtattaccctaacaccatagccgaagacaacacacacacacaccagattaatattgcttatacagatgtaaaaatcctcaacaaagtactaacaaattgaatccaatagcatactaaaaggatagtacatcatggccaagtgggatttagtccaggaacataaggctggcccaacataagaaaatcaatcaatgcaatacattacgttaatagaacaatggaaaaaaaaacatgattatctaaattaaagaaaaccatatgacaaaattcaacatcttttcatgataaaacaattcagaaatctagcaataaaagggaacttattcaacatcataaagagcagttaggaaaaaaacccacagctaacaccatactcaatagtagaagagtaaaaacttttccccacaagatcagaaacatgacaaggatgcccgctttcaccactgctgttcatcattgtactggaagttctagccagagaaattaggaaagaaaaagaaatattaataaaagacatgcaaagaaagcgggaaggaagaagtacaactaattctatttgcagatgtcatcatactatacattggaatcccaagaatccattaaaactattactacagctaataaacaaatttagcaacattgaaggatacaagataaacagaaaagcctattgtgtttctatacatcagcaatgaacaatcccaaaagtaaatttaaaaaaaaaaattcaatttacagcaacatccaaaagaatgaaatacctaggaacaagcttaaacaaggaggtaaaggctttctacactaaaaactataaaactttgctcaagaaattaaagaagacctaaataaataaaaagatattacatgtctatggattaaaagatttagtattgctaaggtgacaatatgccccaaattaacccacagattcagtgaaatcccaatcaaaatcctaatagcatttttgcagaaatgaaaaagcggattctcaaattcatatggaatgacaagagaccccaaatagccaaaatgatattgaaaaagaacaaagctgggggaatcatacctcacaatttcaaaacatactacagtgatcaaaacagtctactggcataagaatagatgtatagactactgacataaaatctagagtccagaaataaacccatatatctatggacaagtgactttcaacaagagtgccaagaccactcaatggagagagaacagcctcttcagcaagtggtgttgagacaactggatacctacatgcaaaaccatgatgttggaatcctgccttatgctatatacaataattaacccaaaatggatcagtggcccaaacataagagctaaaactagaaaactcttttaaaaaatggcagaaaaacttcatgacattggattcggcaatgacttccttgacatcataaacaagggcaacagaaaatagacaaattggactacatcataatttaaaaccttgtgcattaaaggacactatcaacaaagtaaaaaggcaacacaggggatgggggaaatatttgccaatcatatctctgataaggaattgacatctagaacctacaactcaagaacaacgagaaaaacagatcaaaaaatgagaaaaggaacattattgaattatacatttaaaatagttgagagaaattctgtgatgagttttattttactattaacacaattcatatttttttttaaaaaattggcaaagaagttgaatagacacttctccaaggaagatatattcaaatgaccaacaagcacatggaaagatgatcagtatcttttgttattagggaaatacaaatcaaaaccatagtaagataaatttatcttacttggaattttaaaaagggaaaataacaattttggcgaggatgtggagagaatggaacccttgtattatatgataataaaaatgcaaaattatgcggttgctgtagaacatcatttggtagttaaaaagttaaacccagagccgggcacggtgtcttaggcctgtaatcccagcattttgggagaccaaagagggcagatcacgaggtcaggagatagagaccatcttggctaacacggtgaaaccccgtctctactaaaaatacaaaaaattagctgggcatggtggcacgcacctgtaatcccagctactcaggaggctgaggcaggagaatcgcttgaacccaggaggcagaggttgccatgagccgagatggcgccactgcacaccagcctgggcgacagagtgagactctgtctcaaaaaaaaaaaaaaaaaaaaaaaaagttaaactcagaattacggtatgattcagcaactccaatcctagatacacatccaaaagaagtgaagccaggtactgaaataaatgcctgaaataaatattcatagcagcactattcacaatagccaaaggtagaaacaaccgaaatggccattgagggataaatggataaacaaattttggtatagccatacaatggaatattctttggccaagtactgatacatgctacaatatagatgaatctagaaaacactgcggtatgtgaaagaagttaggcacaaaaggccacaaattgcatgattccatttctatgaaatgtccagaatacgtaaatccataaacacaatgcagactggtggttgccagggactgagggaagagtggggtggggaacaaatgcttagttcagtggtccccagacttttgggcacccaggaccagtttcatggaagacatcttccacagatggggtgggtgggggtggttttgggatgaaactgttccacctcagatcattagacattagattctcataaggagttcacaacctagatctcacagttcacaatacggtttgcactcctgagaatccaatgctgctgctgatctgacaggaggtggagctcaggcggtaatgcttatccaccactcaactgttgctgtgcagcctggttctttacaggccatggcccatggcccatgacccaagagttggggacccctggcttaatgtatacaaggtttccttttggggtgatgaagtttcgtaactaggtaaaggtggtagttgcaaaacattaagaatatgctaaatgccactgatttgttcgctttaaaatggttcattttgtattatgtgagtttcatttccattaaaacaaacaattggcagagtacagtcacaatattaatttaaaaaatattagaagcaaatcataaacatgttagcaacaactaatttcttcagtgtagaggtaggactgggtttggttttcttctttttgctgaattacattttgcaaaatttctcttatgaatatttacgacccttaaataacacctccaaaaaactgttcccctgaactgcatgttcagttcaaggaaaaaaaaagatctctaattataagatgtgctaggaatggcctggtgtagagacagatgacaaacaggcctgtcaattctaacagatgttatattcagatcttgacagtgaccctaagctgtgttctcctcctcttattattccctaaaagttatgcagatacagacaaaaagaagatgagattagaagtataagtgaactctccctattaattcagacatgattggcaatttggactgtggatgctatgaaatggggaagattcagaaaagtgcccatatcagtgatagaaattgtaagggtgccataataaaactgcttccacttgttgcatgcatatttggaaatgaagatagaggctaaaagactgagtggctgtggctggtcagggtgaagggagggtcattcttcaagagattacgcaagtgacagcagacagctgttctacttctaatgggaactcagagtgctacttaaatagtaccctgaacgcttctgcttctatattaggaaggacttaattccgagagtagtggcttctcagatgcaagcccaagggagactttcactctctcctttaagaatagctcaagttaagactgtggaacctacagactagaggacttggaaaagattatttccaagcatgagggttttgcaacctttgatctaattaattatgtttgaagagtctggcttatttatgagaggtgagctttgtaattgtgacattgggagccaaaatatcttttccaaatctcattccagaccttcctgccagagactctggtgctggatcaccttctgtaacagacccacagaggcacgctagaagataacatcagccagacatgaaatctgttgtgaatttgttcaaacactcgtctgctcaagctaaagggcaaagataggcacgtgggtctgtaaaagggtaatcagctccaggagggcaggcagcaatccttggaaggggggcaaaatggttgcagagttacatgtgcttgatccagtgccatggaggtgtcctgcatgccacccggcacagcggttaaatctccaccactggaatgctcctttgcaagtcctctccagataagaaggaaagaatgtagcagttaagaatcttatcgttcaaaatacctgtccccagggacccgcctgccaggatgcacattccggctgctgacaagtctgcatagatgttggcttggtctcagggtcacacattctatcatttaatcgatcttcaccaaactgacaccagacctggcggtgcttatgcccttttccacaggtgaccaagcactgtaatgaaaagcggagctagtcagggtcatttctgatcaatgtgttgtggtttctggggttatttattgatgagtaggaacaggtgtgtccttttcccacagcaatcactctcccatagcaatttgtaaatatactaagcctcatttttttccttttgttcgttcatttattcattcattctatatttatagtctctgggccagttttgagcacaaaataaactaaacacagctccatgctataaaatttgaaaaacaacattcataattttatagcataggagttaagcatggggaattataaatcacatcaacctaagttttaacacttatataaccagtcacaagatctctctgaacctcaattttctcatctgtaaaatgagaattagtgtctactgcaaagggttgtgaaaactaaatgaaacaaatacaagtaaagctcttggcacaatgttcatttaataaatgccaaatgtaatcatcattttatccatacttactgtagaaaatttgaaaactgtagaaaaacataaatgaaaaaattataatgacccaaaatctcgctacccaaggataaccattatcaatattttattattttctttccagtctttttaagcaactttggattatagtgaatttacagtttgatctcccaacccccattttatcgcatattattgcaaaggtttgttacttagtttgaaattatactttagtattagctatctaagtaaaatttaaacctactacttatctttttttaaccaaatactagagatttttaagcaaaggcaatttgttaacctagaactaaagcactaggtttgcagttcatttgtccaggaatcagacactgttaatcaaatacactgttaattgactgccatttcaggggcattaagagtatccttttcagatttatttgatggtgaaaataagcagttaatactgcacttataaggatgggataagagcatggatgtaggagctgtagcagggagactttttctttccccatattcctgatttggcccattaaaaaggaaacttctgtttcgtatttcttatttcccttcttccccttaaggaacgtggagtgagtccctgcttggtaagaatctccttgggctgtgttaacactgggctgtgttaatagtgagtgctaatactatatcataaaagcaagaaagaggctgcatcttctttctcttgttgtcctgggaccatctgtgctaagcaatggagggtttgccttgtgcttcataaagtaaaggatgagaaaggcataaatctggaatactcagtctggtccatttcttttctttttttttttttccgagttttatttttttttcttgcagttggatgggtaagtcagagaggtcactccctggggtctaattctcttatttcaaagacaaggaagtaggaaacttcatgttgacttcagatgtgagctagtatagctttatgattaataaatccatgatttcctttcagtgacttagctagggctcaaagaggagggaaggtgatggactgcaacttcaaaatcacaacagaagctacaacagtgagtgatctagccaagcccaaagtgccctgaggtcactggtagactagttacatccagtacgacagtcatggtgcaggcagagaactggagttgttttctcaagggagacaagggagaaagggagaggtgggagaaaggtgcacaagggtttgtcttaaacagatagagagcaccagaactagaatgtaagagatgacctaggggaaataacagccctcccatcttacctctgaccagtctccagatttccactgtggacaagggaactcactgcacctctgaatggtaactttctcttgatgtgtgcatttgctgtcatccagtacatcatttcgggtattgacacaaatagcccttctcctctgggtcccaccgtcacagctttttgaacactgtagggacaaaataaataaataaaactgttgctaagtttcttataaagtatgctgaagatcctggctatgttgtctcttccagctcttaagaaacaacacacaagctggccaactctagttattttggtggagatcttttcatgttatcagtttgcttaccaggtttataattaaactcaaaattagctcattggcatataaaaataaaaccggaaatggcttgtagagtatgcaaaagaaatcagttgagttgttccacttcttccaaatttccacacgtcatgcccatgtcagacattacaaatcaaccatgctactctattctggaaagcttgaatggggtcaggcattacaaatcaatcacggtcatctcttccgcacagcctaaatggggcttacacacctgcaaggagccaccatcaactaatcagacagcatccaagaagactctttgagtgagagccaacttacttcagtccaggcagaatagcgccagccacccgtgttacattcccctgagcatttttcacggttgcttggtttgggatggctgctgcaaaaaccatcatcaaccttctcagtcttcccatccagcctgctatatttggcacagtagatgtccaatgtgcggtaacccaagccacactgggcactacattcactcctgctggcaacatgccacctatgcaaaaataatggggcaaaaccaacatttctgttaaaaatatatgccttatctatagtcaactggtattcatagaagagttgagttcttttttctttcttaactcgaataccatgaagcccaaagccacagtcagttgctaaaatctaattttaaaccaacatatccatgtgtttttcatggctgccaatgtacatagaagtcacagaatgacagccagaggtgttacctttgtgatgattttaccccgatagtcaatctgaaattcaagctaccaaaaggaaaacatttttttcaagtgtattaaaacctgtgtacattattatctgtaaataaaggctcttaaattccttgaagacatggactatattttatacaattcaattatacactttaaaattagatttgaatctataaatctctgtcacctttgtatccatactacctgtaatgagattatggggggacacagtaggtattcagtgtgtgctggccaatcgtctggttcttttaataccctaggaatatgatcagcagtgcttaaatttaaaaagaaaataaataatattcttaaactaaatagaatattctaaataaatgaccttaaaatgtattttgttgattagatttagaaatccaaaaagggtgatttccttgtactcttcattggatttcactcttgactgttcactcatcactgcttagaaattgtgtggtttgttggttaccaatgtcctgagactacttccatgtgtacctgtccagggtagaactcagggtaaaaaagagttctggcctcatgcttatcttggaatttctcatgaatgccccaaagtaggtcagagttgaccatctggcaagtaaagtgggctatggagattttccaatagagtgacaccatatttgggggattttgttctaacccggaacatgttcaatgagaaattgtaaaacaatgctttatctcatcctgtcacagtgtagtggggcaaactctcacttccttcaggaagtgtggcaaaaatgtggcccaatttaacagaagcatctggaactttcatctgccctttgattcttggctaccttctctttgccttcgtcaccatttccttgtggaaaggttattttccatcctggatgaagaaggaaggtgtcctgcctccacaagaaaacatgccagcagcttagcatggcagagtggctcaagtgcccctgacagtaacatcatccccagaatctgagcagagaatcttgaagagtctatggaaagggcatagcgcagccttagaaaagttctcaaaatgctaccccctgctttgtagtctctccctggatggtggtcttcaatgtttcgtgttcatttagttcatttcaagggacataaaatacaattgtattttaatactatatttcaggaaaccatattccaaagtgttgttactaagtagaaactgagaaaaaaaaagtgtaagcctgtgtgtttttattgcaggggaagttgtgggattaaataattttaagaacgactgaattcaaaaggttttatatattacagaacttttcaaggccttcaaaatgttgatcagcattattaacctccacagggggaaggagattcttggtaagtcttgtcagacatactggtgtgccatgaatcatcattcaaaatgagtgatccacaaccatgcgtttggaaaagctatttcagagtttgaccaatcagtaacaatcttctcttcagtctttcagttttggacacagctacttgacaataattactataaatcatggttatattgactgtcagtttgatagatgcaagatagaacaccttatttaggcttggtttgtgtcggtgtatttttcagtgaacgattttattttcccaacaatctatacaggccagtaagctacgcatttaaaagctgacaaataggcatgatcttctggttaattttaggaatgagcatgcacctgtctaatgaggccttggaaactaatcctaaactcctggtttttctttgcattttaaaattcctaaccctatgatcttcatatctaccaaaagacctggacataatccctttaccttttctttaattagaggtgctattattaccattggcctatgatctgacgtgctgtccttgtttggtctgagtagagtacatataaaagttaagtgtcaaaaaaatagtgactttctccaaatgggaaatttagaatttagaatagcttagtgtgctagcatacctactatatgaaacacaaagaactgaagccctaattacagctaggtattgtgacattatttttaataaaaatcagaggatgaactatggaatcagaaagacctggatgtgagtgtcaattaagtgaccctagttgcgtgcttcactaagcctcagtttcctcatctgtgaaatggagggaaacagaacctatttcactgggatatttgggggattgagtgaggcaagccatgtgtagcatttcacacatatggcagacattcaagaaaagtagctattcctgttataatttattattattattatcattatccttggtgtttcattctccaaccaagttttaagcatcatgtaactccacgtaaaccaatgagcggaaatctatttgagatcttttgcatcattttacacaaaaactcatggcttcgggggtaccttttaatgtattagctttataagcactgtttacattttatgtctaaaggcttccaatgcaggagaaactttggagaacaccacataagccagcatcatcacaaattaaatagtggctcactttggaatctgctcaaagtgaaaaatagtttttcaaaataacagctcaaacattatctccaccctcaaattggtgctccatgggtaaacttaaaaagagggttcttaaagaattatttattttttagatcacattctattattcgcaatgctatgtataaatccaccatctgtgcgatcataggagcatacttagcactgtaggcaggagttctgctgtatctatagttataatcagagactcaaccagtctcgttctgattcaatcagtggagaaaaaacaggtaaggggctccaagcaaggtagggaacagggatggggcaaaaaaactcatgggaattatttcttttcacaaaggaagagaagctacccagaatagaatccatgagtaacactcatcgttataactgaattaagaataaaaataactctctcctaggatttaagcacaggatctaggtacagatttagatttccgtcactccactaactcgttgtgtgagcttgtgcaatttgtttaacgactctcagcctctattttccttatttgtaaagtggtaagaataataatatataaatcataatgttgtttgaagaattagtagggtattaattatattaacaggataatagataatgggataatataagaacaatcctattagtaaaagaatattaataggataatatataactgttagaaaaaatagttcttagtaaatggttgactctattaccataaccattacagagtactggggaatatagtgataatttgatataaggctacccagaaaatgtcaccattctcaatttattaaggttgtgcctcaaggaatctatccaccaattcatttttttccccaaactgtagtgattaattcagtttagcggttagttaactaattattttttcctgaagagacttgaactttaatttaactcaattggctgaaacaaagatgggtttatatggacactatctacaacaagaatattgcctagtataaacgtctgccttttaatgtcttcctgtttttttttttttacaatgacttttgtcaatatattttggcaagccaatttcactagggcaatgagctagaaagtcagtgacactgggtagaggctagaaagatcctgggctttgaagtcagagccttcagtcagaactggcaaaaatatgacactcgtaccataactgctcctctcacttccatggcagacattagtagtcaatctcagaactcctctattttctcagagcctcaagtaggcctcataatctgccctaaagcactacaggcagccaataccctttgataggatttggcattgtaatgtggagccttcaaagtgcttaagtattcacttttctgcttataaatggtgagaccttaacacattcctataccactctccactgaatttcccttcttaaaaggaggacaaaacagcaactcaccttaactgcatttaactgtcatgcagagtataaaatgcaagccccgactacttaatatttcaatatgacacagtcaaccttgcaggcaaatagaaaagcttcagaatgctctacccacccagtatttcctgcctcggattttacacttttcttaaacacagaattgtttgaatatctcagacatccatatatacattttcttcttgtttcttccatgacgctaccttagtgtactgcaactttcaggtgtgtaggagttcttctactgggtggtatacactctcggtagatataggtcattatgggtactttgagggatgaggttctcccccttttcttttgactttcaaaacaagttttcacgtacaatgtgactcaatcataatgctaatacctacccagcaagttgtgaggatcaactgaattttttttggcaagtgccatactctattagctatttttaattcttaggtgaacaagaaatctgcacatgtatgtcttggataatcagttccagagggatggagaattggttaaagcttatttcactgaaacacaagaaaggggaactaaagaccagcatcccctccttttgcttctcctgctgggacctcctgcaagactctcacaattcagtaataaaggccttgagaaaacagtggcccacctcaggtcacagtctgtaccacagggttcagtaatgtgtccaggctggggcagccgatcgcatctttgatcagaaacagtaagctgatcagattccctggtgcaaacaagttttcgtttccgttcccctaagcagaaagggaaaaaaaattattcagggaaaataatctattccataaactatttagaccccggattggcaagcattttctctaaagagccagacagtaaatatcttcagagcgtatgatctctgttgcactattcaaccctgacattacagggcaaaagcagccactcacaggcaatacataaacaaaattgtcatgactgtgttccaataaaactttatttgtaaaagtaggtaggccgggcacagtggctcaaacctgtaatcccagcattttgggaggctgaggtgggcggatcatctgaggtcagatgtttgagaacagcctggctaacgtggtgaaacccgttctctaccaaaaacacaaaaattacccgggcatggtggcatgcacctgtgatcccagctactcgggagactgaggcatgagaattgcttgaaccagggaggcacaggttgcagtgggctgagattgtgccactgcactccagcctgggcgacagaccaagactccatctcaaaaaaataaaaaaataaaaaaataaaaaaataaaaagaaaagaaaaagaaaaaaaaggtaggcggtaggctggatttggcctgctggctgtggtttgctgactcctcatttagacaaaagaaaacaaaataaataacatatgctatgactactaaaaccatgctctggaaaattacaatggcggaggtgatttttgcttggttttacacatgtgtacaaaaatttcttaggatgaagaaatctaaaatttcttgaatcacttaaaaagttcaacttcccagccaaaaatgaccagacacattcaaagaaaagagattagagaacgtatgcagatagaagggtttgcagtttgcatgcatttggctgttattaaaaataaataaataaataaaataaacttctcaaatccccagaactcaaattcaaagcagataccttggcagggtttactgcatgcttgccatggcccatgactgttccagtaaaactgctgaggtttatcttcaattggaatattgaaagaatagcgtacatcggggttgtacaactttcccaccgacaaaacctagaatgtgtggacaaaacagaaacgaactgggtgggcttagtaatgccaagcagaagaaaagggtggtgggctcatggtcaagtttttacctgaagcaaaagttcttgctcaatgcgatctgttgagttaattctttctacggcagtctcggacccactgtactctaccacagcattcccaatgcgaatttcccttttggccattgtgacaacaaagtttccatttagcaagaattcacctttactgcttgataaagctgtaggtgaagaaacagaataatacattgatctgctgtcaatgactagctgtttgaaatatgaagtaacatctggataggtagagagtcgctgtgcacggaatggggacttttgaggcagacaggcatggcttcaagtcccaagtttgctacttgccagctgtgtggctttgggaatcattttccatccatctccatttctttatctctaaagtggagataaaagcacctactcccttgtggtatctgtgaaaaataaaatgtaacctaggtgtcctaataaaccttgatcttgttatacaagacccacagttatagaattatagatggaaacaaaagtgtttatatgatttgaaaatatgcattagtgaacggaacacttacaaaattggttcctagacaaatctatatatactagaattagtcaagcctgttgaatctttgttaagtcttttttgtttgacagatgttgaaatctgaaaatccatggttaatatgatgctcaaagatctccttatcagtgtagctcactgtggtagccagcctcaaatatggccccaacgagccttgtggcatggtattcacactatgtgtcatcccctcccacattcaataggaatgactgcaatcactaggacaatgcagaaacaacagaacctgacttctaaggcaaggccaaaggcactttggctctgccttgctcttccttggacctctggttctggaagaagccagctgccatgttgtgaggatactaaagaacccacagagaggcctgcaagcagcagggaagtactgactccttctgccaacaccctctgagtgagtaatctgggaagtggattctccagccctagttgagtcttcagataatactacattcctaactgccatcttgactacaacctcatgagagacttcaagccagaaacacccgtatatgctgctcccaaattccttacatgagaaactgagagatagtatatatttgttgttctaagccactatgtcctgagataatttgttacacagtaaaagattaatacaccaacccagaccattatttctaaacctgcaactgcctcccattgttagcacatattacatactctctatccgctttctcatctttctccatggcactttgtttatactctctctttccaaacaagaatgtaagacccatgatggtaagaatgttgggatcattttattcactactgtaccccagtttctgaaagagcacatggcaggtgctcagtaaatatgtatcttcggggaagaatgaatgaatctactccagatcttgcaaaagatgaaaaaaatcagtgatgctgcaaaagtgatattggagaactgcttgaatcgagtgccaaaatgttggccaaatgagaacctggcagagttagaccagttatggaatctaaaatagtcaaacccatagaagcagagggtagagtggtaaatgccaggggcaggagggaggggggatggggagatgttggtcaaagatacaaagattcagttaagcaagatgaatacattctggagatctagtatacagcaatgtgactatagttaactttagtgtattgcacacttgaaatttgcttaaagggtagatgataagtgttgaaataaacaaagagagtgggaaagagaaagaagaaagaaaggaaaagagagacaaagaaagaaaaggaaagaggaaggaaggagggaagaaaagaaaaaagaaaacaaaaggaaatggtaactatatgggtgatagatacattaattaggttggttttggtgattatttcacactgtataggagtataaaaacataaagttgaacaccttaaatatatgcaatttttatttgtcaagtatcccttgatgaagctgaaaaaagaaacaggaaagaaaattgacaaggaggatgagacaacagctgcttcagaagaaattatttatttattaaaaggtcaagagagcttattgggaaagttaataaatctctagaaagcttttctaaaattgactccctttcagatttcactgttaaatccagactttcagtcaagaatatactactttgctattatgtgacttgatatgaaaaatatatgcaaaaatatttatcaattgccttattcttttcaaaaccttggcatgattaaaatgaagatgtaattttgttgatggtcaaatacaaataaatttattttcataatttttgattaatttctcaagataaaatctcaatcacatcttttccttttagtatttaattcaaaattttgattgtgctgcttttttctcccctggtaccactgctccttgaataagtcctcttgagtgttgggcttgacatgaagcaggtatttaataaatcagagctattaaaaatttgggctctgaacaaagactagagaaaggcccccccttaccgtctgtaatttgtgcaagagtagcaaattttagtagtgaggatgcccttgaaagatacaggccatatatttaggtgaataaaagaaacaaggacatttaactcacagatggcaaataattttcatccccggtgccaatgtcaatcaattggtaacagccgcccaagaaaccatgctgaacgtgattcaccaacagcatcatgtcttagcatcatattgatgatacctgtattggttgtggaatgaggagtggacaagatgtcttaggtattagctagatcctaactcatctttcattgatgcaggccatctcatcaatgtaggtgacacattatctttcaccactcaggagagaagcaatgtgtacacagaagaggttccaaggatttaggttaagtaaatattatatccttatgtggatactaaagagggcagagatgaagctctgaatatttgtggttcagcagcagcaggatccttaattttcatagacatgggaacctcacagagttcatgcaattggacaccttactgacgcagggctattcattccaggattaggaattaactgcattgaattctgttcctaatccagcacttcatttaccagaattctcacccacataaacaacatctggccccaagagaagaataaggtgccttcatctgaaatgactgagaagaatgtggtgacactgggaaatgtcaagattagcttttaaaaggataaaataccctccaacttcttggctcaaaatcctttggaagtcaccactacctacaagatagtacaacctccttagcatagcctccctgtaactttacaaatcttaatcttcacctatcttcctagtctgaccattcactcccaccaataaacctaaatttcaagtcctgtatatttccaggtcagccatatatccttctacatggtggcagtaaagtgaactggttaagtgtgtagcgtctgaagtctgacccataaggataccaatctttcccattttctatttgtatcaccttggataaattacttaacctctccaagcctcagtttcttcctctgtataatgagtttcttataggattgttatatggattaaataagaatccatatcagctttagttcctggcagatcaaaatgcctttgtatgtactgtctccttatcacacttctataaggtagtgtctattatagaagcctaatttatggatgagaaaggcatgacttaaaatagttaatttcccaaggccaggtggctcctaatcatggaaatccatttccagagtctacaaactactaaaattttccaagaagggggtcaacaaacgtttgttaaatgagtaaatgagttcatgcattcgttctcttgtatacaaatagaaactaagtatgtttgtgttgtagatttttcttaaatgtaaattgctcattttgttagtctgcatgagcccttgagcaaagcagccatttaaaaatccacttttttgactaatagacattggagagtaccaaaggtgggaggataaaaggaggataagggttgaaaaactacctattgggtacaatgctcattatttgggtaatgggtactctaaaagctcagacttcaccactacccaatatatgcacgtaagaaacctgtagtcctaccccttaaatatataagatgataaaatacaaatttacttttataagcccaagaaagatcccaacccatagtaggtgctcaatcgatgatgctgaaagaataagtgattgatggagtctgacactcatgacaaggaggatagagtgcttccagccaaatgactctttctcagtcagtgtaaacctctgacaacctcgtcttgcctgcagctcctgcagcgcgagacccatcagccatgaaagaggcaggagtttcaatgggtcactgaagccaaggttgtttccgtggcaccttgggcatcctgaggctgctccctaatgcgggtcattcaaatggtgacagtatgatgtgctgtcaacaaaatcacccagttctttcaaatgaagttgcatgctagctacccagctgatgtcttgataaaaaggaggaaataaaaagtcagatgccggttctgtaaatcaagtgataatccagtgtggtcatatgcaaagagtgatagtctattctgggttaatttggggggtcttttccaatgtctccaggtttcctttcatgctttgctgactcagggcatttcacccttccatgcatattctttattccagtagatgtgagtagggagaaagagaggagcacaaatgatatcggattcctcttacgatctgccgtgataaatggtttggccccagacatccttaaaatcatcagatgaaaaaaaaaaatcctattttatcttgcactgcatcgattcccatcttcccattgccacaattaatcaagagctaagtgtactggagacaaataagtatcacagaaatggctactttttcttctaaagagatacgaacatggtggccctgggtacaacttggctttagctcaacaggaggaaggggtccatgtgaaaggatgacctttgacaggaaggcttcctgctttggtactttgtgaaacaaatagtttcctgaaaacaagagcctaatgcccaacctcccactaatgcgattaagggagctaatttcctgggttggtttccctcccattgcacccatcagagctgggttgctacaaaaggccctctctcctggaaattcctccctcctagaatacacagaaaagtatggcttggctgacactgaaaaaaaacataagggataaggatgaatattgcttagcaatggaacagctgtgactggactcaacgcgagactcagtgtgggttgtaaaaccttctcagtgcatgtgctgcatcttccatcaagccaagagtaaatatttacatatgccagacttgatgacaacatcaaattcttcctaacttgttgagtaaccaccgtgaggttcaaaggctctgaggtctcgactttcacactcagtggactgtgacttgcaatgtaggcttgcacacttttcatttgcttctagagagacttccttatgccaacaggtgactttcccattctattccgttaaagtgtcataactggctcagattgcctgtgccagatgacaaatcttccttaattttgttttcattctttacaaggagattaagaaacctccactgaataataaaaggttatcaggaggccctccctgaattcaggtgcttgatgtgcattgattaagttgacttgaattgaggccactacttggagggagattgtttttccaagaaagggaagaatagcagagaatccttctctctttcgaagagaagaaaggagcaactcaacatggccttcaggtctcaggaaattaatttataaagcaggctgcatgcaatgctgtttcatttaattaggaagtagtaaggacactgcagccacatgctcaaatttataaccaagtgtacaaagaaaaatacttgccccattctgcagctgtgcaaggagaaatggattccccccccaaaataatttgtaaacagtcctccaagaactttgttaattgtcttataaagttgtcactcatttggatgtttggggtagtgaaaagctgatgtagtgattgagtaattaattccaagtaaggctttacggcccttgaaagaagaggtgaatgtacattttcaagctaaccccattctccattaagtgcacagtaggtagtcattaaagacagcattgacaacggctgttcaacaattcagcaatcatctgctttgtaccaatcatatgtaggcttcatatcagtagctgaagatgtaaagaccctgccctaactttaaaacactagtggtcgtataataaatatgtaactagtcttgtcatctcagttgatgacaactccatccttcccattgctcaggttttgaccttggagttttgagattcctttgtacctttagtcttgtgtacttttaactcctttgtacctttaactcacacactatgttcaatccatcaacaagtcatattggttccaacttcaaaagatatccagaatctaactacatactgccactttcactgctcccattggggccaagccaccagcatctccctcctggattactgcaatgatttcctaatcaatggcaccgcttctgtcctgtacacacttcccccaccatctcttctcaatgtaccagccagagtgctcctttaaaaacataaatgcagtaagacgtcattcctcagctcaaaacctccagtggctcctgatgtctctgagtccaagccaaagttcttaaaatggttatatggtcgtgtatgacctagtcttgtttaaccttacctaggagtgtcctctgtgctcacttggcaacagccatactgcctccgtcttccctacttcaaggactttgcaatggctattccctctgcctggaatgctcttcccctaaatagcttattatcttgctctatgattcaaacatttcaactctactgtccacatctcacccttggtatcccgatttgccttaggctgctctgatttctagcagcacttatcactataacactatggagttttcttatctatcaggttactgtttattgcctattgtttattgtcccactaaaaagtaacgtccaagaagacacaaatttttttttatctgttttgttcattgtgcctagaacagtgcctggcacatattaaataagtgagtgagtgactgaatgaatagtgatagcaaatgccataatggagtcatgtataaatatcatacttgattagcatgcttagctgaaggctcactgtctatctatgcagcttcatgtagacattccaaaacagagatatagactttaattcagttcaacaaatactcatttaccagctgaatatgtccaaatgcttagattaagggcctctatacaggttgaattcagatgaataaatagagttcctgcctggatattacaataaagaaagtacattattgctttttaagattgactgcccagcaagacagctctaatttattctagatctgagtgtaagccatgcggctgggaagagttttgtgtaaggtgatcagttaaatccctttcagtcatgactctactctccatgtcctctttcttttaaatggcaattaggcaaatttcacaatcacttacagcaatttacagaaaaacaaattacagtgagactgggctgggcatggtggctcatgcctggaatctcagcactttgggaggccaaggcaggaagatcgcttgaggccaggagttcaagcccagcctgggcaacatagtgagacatcatctctataaataagaaataaaaataaataaaaaacaactagctgtgcatagtggtgagtgcctatagtcccagctactcaggctgaggtgggaggatcacttgagcctgggaggttgaagatgcagtgagctgtgatcacaccactgcactccagcctcggtgacagagtgagaccctgtcccaaaaatacagggaagggaacaacacacaatggggcttgtgggatgcaggatgtgtgggcaagggagagcatcaggaaaaatagctaatgcatgctgggcttaatacctaggtgaggggttgacaggtacagcaaatcaccatggcacacgtttacctatgtaacaaacccgcacatcttgaacatgtactccagaactttaagttaaaaaataaaaaaataataaaataagatgggactgggctgagcaaactgttgaaaatcaacacagggtcatcggcatgttgtggtttaaatataaggaatagatatgaattaatcatgcacctcagttcagtgagaagaggataaaaaatctgtatagtattgctattctagtaatgacttgagaaaaatacgtgtcaccatagaaacttttgcaacgaacaggcataatgaaatactgaataagtctaccagtggtctgctactggttagagctgataacataaaaattaagtcaagtaatgcttctaataaaatatttgcaagtcagttccccacaggacagctttttgaaaagactcaatgagagcaaggattttatgctaaacttagaggataagtactttcaaaatttgacttggggcctttctattttttaagatccagagtaaatcccttgatatcaaatagtgcagctacacaacttttcaatcaatactctgagggcgtatgtatgagggagaaatacaatggtgaattttgagagccacttattttatgaaaatccatgacatctgaaagctctgcctctgcatgccagagaaggaaggaagcagtatctggccactgctccatagaaccagaactcgcaagtagtgaggcatcccatctcacctaagtagttgtcatcgtctgtttcccctgagaaactgtgctgccgcacatcaatattggtagcaccagctggaattcggaccacagtattgtaacctgaaaagaatttagcagaaattcagtactccacagaatggttcactttctctaagtatggaataaaaagtggacaacaaaggaatagaatataattctcatataattctattaggtgccttctagtcgatggataatccaccataacgagactgatttttatgctcgacattaatatttttgcatattacatgtggttaacaattttcaaactttgaccatattccttctcatggttcttaggagcagattcttaccataatgtactgtattaaatgttcctgccactgttttgcatgaagaattatcgccaccacaaaccccacatttatctctccgggcttttgagtttaaaacatgatcgcatccagcttgcttttaaaaagaaaagatttgaaataaatgtaagcattatagagattataaaatggcaaataatgtgtttcttttaatcgtgtgcactaaaaatgacaagaaagtcaagtcctttaaaacttggaaaggttgaaaactgaaattatatactgccttgctatttaaaatgtggtccttggaccagcagccatgggcacctttgatgtggtcaggaatgcagaatttcaggacccacccagatctactggatcagagttggcattttaataggattcctcaggtgcttcatctacagataaaagtttgaaaagcactagtctgtaagtaagcacagtaattttttaaaaaattgcttaggaatgaaaaaaaaagggaataggtaagaactgtatctaattaaagagctcatgccccatcttaagggagtagctgctgtccactccagactattgctgccatgagggaatgggagccctgtgttgacattttttcccaattttccaaagaagctggaaaaattgactttatgtaaaatcccatacgtttaaatattggctatgaatgccagccaaagtatgaccatgggcctccattttgaggcctgaggctccatcgagtggcctgctgaatttctcctcatattaacacaatgcagccatgtacactgaactctgaaacatacactgacaatgaccagaagaccagaagaagagagtccacattcttgtccgttttgttcatttgtgtgaactaatctttgaggaaaaactcaatgtgttgctgtgaaatggacagacaaggaaatctgcagtataagctattagtcagtgggtgatgcccttaggggctctttcaatcaaatccttccaaccaggaactccaatatgcctttggaccacaggcaaaaaaaaaaaaacaaacaaaaaaaacaaccagaggcatcatctcagagcccaaccgggttaggaataatttttgactaacgagaacgttgaaatggtatctagcccctgagaaatcactgctctgatgctttgctgtttcccagaagtttctcaatttccctttcaagaataattaattaacaggaatgtctcaggtaaaaatgatcgtggttaaaaatgcaaagagaaacttgagtgaggccagctcttcttcctgacatatttctcaccctcagctattcaatctaaaaaatttgctgtcaggaagcatttgggaagcatttgcttaagcactgagtttatagcaaaggagtgtgggtgtaaattgttacaataaatttttaaggagaggttttgtgcaagacccccacagagactgaaaatgtcaagaaaaatccagggcaacggctcccaaactttggcactacacgcatcagaaaaaagtgatattgatgctgttgctgatcccggggccacactttgagaaccactgccctggcaacagtgcacagatactagcagttgctattctatctaggaagccacaaatcacaggttggcagcgggaaaacacagtgaagaaaacaccatcaaggacttacccggcaaaggccctggacacagatatcatttgtgtcctggccacaaggagttccatctatcactctgtctcgaagctgatagtaggctgtgttccctgccactctgcagaacaacttgcaccggtccttcatcagaactagagaggagaaacaatacaacttgacttttgtgcctggcctcagtgccggccggccaacggtgaacagatacaccagacacacttacttccactgtatttagggacccagcgcacattgggaagcagaccgttgatgttaaaatgcttcccgtcaaagtgagcacactgttcatctcggaagtctcgcttctgcttgagacatggctccgtgttgcaggacttaaatttcattctacgtcctacacagtattttccaccattttttggtctgaaaaagaaaaaatgtgaagagcacacacactgtattatcatgtattcctctgaacatcactccttcattcatgacttcctgtcttctagagaagtaaatctagggtggcaaatgacagaggaatgggcaagagctctgatccctggttttgcatcctgccttcaataccatgatgtgtataaccttgggtaagtcacttggcctccgcaatcttcccttatatttgcaaaatgggatgtagctatcttgtaggctgttgtgagaataaatgttagaatgtatagcttaaaatatgagatgcgaagcctgaatctgaatctattaggccactttttgttccttttcttcccaacattcatggtgcttcaatgtttaaaatgtagaaggtgaaaggtacccaagagtagtttggaatgctccctatcttccttttgtaccttgacatattcacaggagaccatcataaacttgttccctcacacctccattcattctgtccctctactccctctctccagacaaccattgtttttgcttttttgtttcacaaataaaatggaataatgggaatgtgttcatattttgactaacttaagaggagaagcaggaaagagcatactggtttcattagcttttgtgtgacgagtgtatggcatacgccttgcaaagcatcacagtgcaaatttaatctccgcatgcaaccctgtgcatgtatattccagatgtgatccagagagtaaattatacaacacatctaccagcagtcagcagcatgccaaattcatcatggaaacaggaagatcacagaatcgtaggacgttggggctcactcacccagggctgaaacagctcgggtttcacaactgccctaggacaaccctgcaactgaaaggacatttttcaccctttttcctttagaatgaatctttcagagtaatctggactataaaaaatgggtttttggctgctttgtttcaaacaggagttttggggaatgagaaatatatccctgctcacgaaatatagaatgagaggtagaaagagctctagagttggatcttggttccaatctggccctatcctcactgtgtggccctagactaagttctcagtcttcctgagcttcaatttttccccttctttacaataagtgcacatagtagatgccataaaatgttacctactatgatacttcatgtcaacactgcccaatctaatctgatccaattctgcagttggcttgagcacccactctgagcaccgaggcaggactcagtgctcctgcagcgtgcccaggtcccacaaaggccctcctagagaagcttgtcctgatactgttataaacgtacttgctcgatcaaagatttgcaacatgaagtaagagcaccagctttgcagttacaagctggggagggtgactttgtgtaagctgtctcaccttcctgggctctatcttcacatgtaaaacagagacgatgctgtgtacttaaaaggcttgttgtgactctgaggaacttagcaagaagtctgatcaacattcaccattatttatcataaggaagactgcatctagggatgtaaaatggcacataacacagtcgtgtctacgtctgtctgtttctgcattaagcacaattaagcccatatactgtatatctgcactattcattcaaactgggaaatctccttcatatcttgtccaaggctagggaagatgaggtgcttttataccaagtgacaggacgtttagagaagtactttgcccaaaggtcacacagctaacaaaggagcagagtcaggactggaatccaagtctcccagactcttctctgtgcacgtctgctacattatccatatgctgtgtttcagagtctttttttttcttttcttttttggtgccatttagagatgcagaatgggtttcctagatccaagcccttttctcagtaccaaggcaccccagtctcatgcataaaatatcacagatgacccatgaataatagatcaggactgtatacctgctcaggtaaaacttgtttcaaatgtgctacaaggaagacccccttcaatttttcctccagttgaaattatctttctggaatctttttagatgtcccagctgactatggtggatcaatcatttatttattgcctgaaagtaactcatacttctttccctttgaacataaagttttttaaattgattttttttgttctcttatatgacacgtcttagctgattcttgaaatttatcaaatgcagcagttcttcggactgcaaatagttattatttataggtggcttcccttcagatggtaacagtttccacctttgcttgctttgaccactataacatggcaagtagtattttgggatttatttttataaaaaacattttttataaacacacaaaaaatactgtatgtgagaggcaatactccttatggttagaaacatggactctggaaacagagggtttgaatcccagctatgcctcttaataatgatgcaatattaggcgagttgcttaatcttgccaagcctccgtttgcttatctgtaaaagggagatgatactaatatctatttcataaagctgtagtgagggttaactagattaatacattcaaagcacttgcacaaagtgtggctcacagtaagtgattaataaaagtttagctattacaagatttggcaaactaccatcctgtgggccaaacccagcccgccattgatttttgcatggtttgtgagctaagaataagttttaaattttaaagtaattgaaaaaaatttttacaaagaagaagattttgggacacatgtgaactatgggaaattcaaatttcagtgtccataaataaagatttattggaacacagccacacccacattgtctgtttgtttcttcgtatatcagtaaggttgagtaattgtgatggagaccacataaacctcaaagcctaaagtatttactatttggccctgatggaaaaggtttcctgatccctggactattcttgtgtcactgtcctacgttccaaattctgtcactgactttgctgagaggggagcccaacccaactctccctgaccagaagctcaagacctggcctctcttccaggctgtctcccttgagacaggcctctttccatatcaaaagttggtctgcaagttgatttgcttttatgtaaaggcaggttacaatttcttccttaattattgacatgactttaacaaatataaattggccttctgaactacatatgtttcctctctcccagattgctgcctgatttacatggactatgtaatagagaaagcttcagccaaccaaactcatctttcagcatggaaaaaaatcattttataatttaattatttagctgaataggagtattttttctagtaggcaaatattgaaaataataggaaacatagctttaaaaaatagtagccacacttcccaactattaagatccttttaaaatattgcatgtcaaatagggatagggagggtttaaggaaattgctagagtaattactattctgcacagccaaattggatctttctttcaagcacatattacacagccatgcctgttaatacatagaaaggaaattcaagatgatgcatgaccaaagctataaagaaatttttgcagaggtcatcacaggtacagtctatcctcaaggaaagctaaactttggtctgcaaaagggtttgaacagaaatcaacttctacgtttaggtacgatgaattagggtagtcagatttagggttggcacaagacatttctaaagatacaacaggcagccccagaaggtagtgtaattcctgtgcctggaggtttttaagaaggggcctgatggccaattatgaagaatgctgaaaggctattcaaagattagatgggatggggtgggagctgtaccagcccatctttaatgatctttccaaatggggcagtctatgaaactggattcttttacttattcattagttaatggctcttccacagtaaccaattctcaacatttcgaaacaacttcatccaaactgagtgcctcagaaaaagccttgctgtaattccttacagccaaatgagaaattcatttttttggatgaaatagacatatgtcttaaatatgtttttaaagtaagatttcataaccagttgctatggagagagcctaagggggaaatatctagttcataatccttttaaccctcaaatctatgagtttattatttttaaattttaacctatctcctaatttaaaagtaaaatagaagcactggaaaaagaaaatgctgtgtctttcctaaggaactgacacgatttttgtttttgatggactgtaacaattctacgtaccattttgtttcagccacaaggaagctctgagccaaattttgagcacaaaacaagtatagggcccaaaagcctgaaaatacatcttctagttccaaagctcagtctggttttggtactgttaagctatgttttggaggttctgattttaaattttactctattacacacgtcttataggctgggtgaccgtgtaattaattgcccaatcaagaacgttctgagagtgaaaatgggagctattaataattccttcagggcaacagatagaacaagggactgtccttgtaaaccagaactatgatcatcttatctgtagggcatggatcaaaattgagattaaaaaaataaagcacttaaagacaaaatatgagggccccacctgtaacaccatatataccagttgagaccaaaatatcttgtgaccaaaattagaaagcgtatggtctctacagcttgttcatggagtagagcataatctcatgtacacggcaaggctacttatcttttttggcttttacgctttcagggggaaaaaaactcttaagaatatactataaagtctctggatgctaaataaatacactcttgaatcagataaatattgtgaaaaaagaaaaaaaaaatccagtgtccttaatagagacataccttgtaccttggattctaaaaacagagctctccattatattgtaagggctcgtcgaactgacaaaaggcatattcccagtgaggggggcagctgttcccctcaaactccttgagaagcatgacagcaaccacttctacgttctacataatgaaccatctgctctgtgaatttctctgaacaagcttttaaactgagatttggatctgattttcccttttctgtgttcctttctcttttcaaattgactcccccagagccattgtaacctccgtattcagaggcagtctccttcctcaattaacagggacatcctaaagtgcaaataacttggaggagttttaatgaaatgatgtcagtgctgacactcaactaggtggattgtttttttttttttttttttaaaaaaaaaaaaaaaaaaacctcccatagcaaacagcagggacaaggacctctaattgaggtctttaatgatcggttcttaacttctgaatgtgaggatctttgttgcactttgaagctcaagatccttttctgctgagatctttacactgggtgattttctttgtctagcccattccaattacggagtgatttatctctctccacttttcacattacttctagaattgctcaagacttaacaaagtattattttaaaaaaggccaaacacttcttttgaatggaatatccttgagtcaaaaatgtttaaagtgcttataaagtggtcactgtttgcaatatccataccctcatgatagcatttactataaactaataactttgctcaatgtagccaccaaatagtttttaatatgtaaaaaattcatcatattagttgttacgatacaaggttttcttttaaagcttcaacaatacaagcaacaaggatgcatagctgagtttaaaaagcagtaccagccttcttttatattatatgatacttattttatattatgtggtacttatttcatataatatgtatttacatccacaatctgaaaagtctgaaatgacacacactgaattacttttcagtgattatttctcatggggagtaggcaggaagtaggaatagtgtgacaacttctaaaatattctatatgtttgtgtctgaattttttgaagcatgatctatatttatactaatatttaaaaaactaattcaaaatataggctatatagaaaatctaaggcttattcatttttatccatagctacagtgttagttttatggaacagagtctgtatctcacagccctttagttatcttccttattgaccactacatggacatgaaataaggttgggttatgaacaaaaataacttaattaatcatcatctgtgatttgtagtacagagtactgagaccagggcttgcaaaccagttgcctacagctatattctttttgattcacacaattcagatttttcatagaaaagattcggaagctttgccaatattagactcttttctcactgccgaacaatcagccagacctgagtagtgccctgcacttggtctctacaatacaactattgtattaccccagcctacttagttcctttacttcacctgtttgcttctcagtacaatagagtttgctatccgtgatctaagctattaaaaataaatgagactgctaggggaaatcattttacaaaatcccaaagcagctggggtcttaaaaatggttgttggtttttacatcaaaaaattgttcctatagacttcttggttcccagcctaaataggttccatggcaagtctgaggaagtgccatacaaactattacttacttttacttacctattattttctattccttttcaactatgtatgtcttagatccatgtaaaattggatgtcattttttataatgaagatagcaatttattatctataaacaaccttcccccaccctccaccccgcccatgtctgctatgacaaatgctgggaaaaaagtccatggactttatttaaacatgtcagtcctaacaaggttaggctggtagaggttgccatggtcacacaatgagaattattctgaaaggcaagagactcccaatctgtaaaatgtcaggttgtgggatggggacctcagctgtctcacctgtaatacaactagattgattaaaaaagtaattccttatcacagaacacattattggtgggaaaaaaagaaaaaaaataaaaagtaattcttgatttggggtcccaggtcccttgaggtctaactagaaggaatatattagtctacaaactggatgaaaatgtccaatttttttgtttccatgtgaaaatctatctagtcactccattagtgtgctatcttttttttttttgcctgctttttttttgttttgttttgttttgtttttgcttttttgttgtttttttatttttattttttattattactatactttaagttttagggtacacgtgcacaatgtgcaggttagttacatatgtatacatgtgccatgctggtgtgctgcacccattaactcgtcatttagcattaggtatatctcctaatgctatccctccccccgccccccaccccacaacagtccccagagtgtgatgttccccttcctgtgtccgtgggttctcattgttaagctctgagtgtagcagggagagtgagacctgcctgattgtcaacactaggaaacagaccgaccacaaaaccatcacctgtttggtagataaaactttgaataacaaaggatcttgagagtaaacaataatacagggggaagtgcctgggaatagactttgggtaccgtgggtctaagcagcccttgaagtttacgttctttctagctctctaagttggaatgtactcttcacccaccaaattattccctttaggaatttcatgttcctgccacggcagtaataacagttatacattctaggacttactctggtctgttgcactctcgaatggctgttttgatgccccctccacatgttctggagcaggttccaaagggactccaacttccccaggatccatctgtcacggggacatccatttctttgggaacacaaaatccatacttgcagtgctgtatttaataaggggaatagtgagggagacttggcgctgtgagttgttacaggactggctgtccttttaaacacaccatactgtaattcttttccatgtgtgggtttgaaatgctgcaggttcatcatctatatgaataatggaagctatagggattttaatctcacacttagtgattttaggctgggtcttcctttacagcttgcttgaataaaactggccagtgactggctccaggctgacagggtaactccaatggcaagcttcaaaccactcaattagtttacttggaaaaaccaggagtggaaatgggaagggtggttatagacagggccaaaatgagttataagatttgcatagtgaatttccatcaacaaggcctagagaagttacaagtctggtaaactataatgctttattgctcccaattttaattatattggagaggggggaaaaaaaaagcgagttacatgattcttataaacacactccaggaaagcgtcaggatgagacgaaagcaaaacggacacactacagagagccctaaactttatgacttgtttgttactagcggtttcagattctccagcctggagcaggaagaaggccatgacgtttaaaaaataataataaaacaaaataaaactcctcagcaggacaagggaggagagaagccattccgaccctctgccattgttggggtgtgaagccctgacacaaagccgaggtcactgagcagtggacaaaggaaaagtggcggcagtggccacaggagggtgacgccccgcggctcgctcagatctctgaagcggagctggtggcgactgtcgtgatttatccccagggaggacacagccaccaagaggggagaggcagagaggtctgaaggccagggggtggggcagtatgcagggaaggtggaaaaagaagaggtaggtgaaggtctcagtgggaatagcaggccccacccccacacaaggcttggtaaacaattatttaaacagtgcaattaagctttctccagtctgcctggcctcctcccttgtaattatcctcttacagtatctgagggcacgtccctttccctgggctgtttggctgaggcttaagatgttctgcatctgaaccctgggtgactcaggacccatgaaatgcgcactgaggcagtggggactacgtcgctctctggaaatcacttcatatttgtctttacagtggttgtgaacatttcttagaaaatatacatataaaaataaatgaacagatggacggctttgtctagagtacctctgtccagtagacacagaacatgaaccacatatataatttaagaatttctaaagtcacataaaaaactaataaaaaacttaaattaattttaatatatttagcccaatctatctaacacattgttatttctacatgtagtcaacataacattactcaataatttttttttttttttttttttttttgagacagagtcttcctctctcacccaggctggagtgcagtggtgcaatcatggctcactgcagcctcaacgtcccaggctcaactgatcctcccacctcagcctcccaagtagctgggaccacaggtgtatgccaccatgctcagctaaatttttttatcttttatagagacagttaggggtgggggtcttagtatgttgcccaggctaatctcaaactcctagactcaagcaatctgccctccttggcctcccaaactgctgggattacaggcatgagccaacacacctggcctactaattagattttttaatgctttttttttttcatactaagtcttcaaatcctgggatgtattttatacctaagcacatctcagttcatgtcgacattttaacatagccacacgtggctggtggccaccatattggacacagcaggtctagacagacaaaacttaacaaaatacaacaggtctcactgggactggtaactcttttacaaaataactctgtggccttgggtgagtccttaaagtctgtttccacaatcaaaaaatggggacctactggccaaaattatttggagtataacatgggacaaagtatgtaacatacttagtatacaacttagcacatgggggaccccacttaaataacagtggcaatgataatggcaaacatgtacactgcacttaatatttgtcaggcactgttctaagcattatatatacaaacttagtcctcacaacacactacgaagtaggtactattattacttccatttttacgaaaagaaaatgaagggacagaggagttgatgccaaacatcacaaagaggcaggaatggtactgaaatatagacaagacttaacagtgcatactcttaactgggacacatgctgcctcttaactgtgagcaaaggggacaatttccgacatctaaataaggactgaagttttcaccaaaagtaagattaatgagatggctaggtaagactgagactccagattattcactcaatatccatcctcccctttatcttggcaatagaacctatattttccaaagtttccctacggatagaggtggtcagagagatgtaagcagaattcactgggtaggattcctgaagaggccctttgaactctttggcttcattctgcggggaagtcagactccatggctggagcaaccacagccattttgtaccttgaggacaaaattaaggagttttctggaaatacattttttccctcttaacacttcagacttcagtttctggatctctttattctatagattttacttccacacaagagcaaattccaaatgaccactcttctcattaagcattactataaacattggaacaaaacaagggggtaggtttatcagagcgctaccatctagcactgcactcaaatgtcctcatagttgctttttaaaagaaaacttctaattcaaaactgatatggaaattaaatatttctcagtaatatgaccattgacaggtgtccaaaagaaaggaagaacttcagaggaatatgaaaagtgtctgatatgacagatgctgggaagggggtctgtttgggaaacatgcaccaagataatctattttaccaggcaaattctacaaataataatcacatagcaaaattactattacattataacaaaacattaagtggctggtgaaataagagccaaaataaagtcagcctttatttaaaatgtccaaaaccatttaaataatattttatagaaatgtatctttttaagaggttggaatggggacttggaggttgattttgtccaaatgaaacttgaaacaaaagagtttcaaacctcagactcacaaataagtttaaaaggaaaatgctaatggacttaagagagtggagaaaataaagagacattagtgagtcattcatcaaaataacattgtgtcagcagcccaagacagattactgctgcaggagcagaacagaaagaagaaaaagaaagaaaaaacattaacccagcagccaagggaggcagaatgtgctagcatatagagaaaaggcacatactggcaactctatgaaaaagaaacaaagcaaaacactcagagaatttctatgccaatatattcaccttctttggcatttctagaatgtgtaaatactcttcaggatatttatatatatccacatctttaataaaagctgctagacatggccacttttctaaaacaactaaaaatggatctatcattttctctgcacagttcttctccaaaagcatcctgagcctgccttgggaatgccttgaaggctcctgctcttgctacaagcacacccacttgcttgtgtttagcaggagcagggtctgctgaaagctctcccgaagctccccatccctcagaagatagaaaattaccctacgatccctcctcttctgcaaaaacagaagattgggaaaagacataattgacatcctccaagttattctgcattccagaattggttgggtaaccatactgctatctggagcttgacagcacgttcatgacagttttactaaatgcaagtcatttcatcacatgattgaaaatttttcgttgttgtgtttcttttgcagcaataacatgtgtcagaaatagacatagtgggtggatccatcaggttaagaaccacaactaaataccagtgatttcactgagatcaaacagattcaatttaagtaatataatgggctggttctaacccaagccaactaaccaagttgtcaaataggtatcatgtttattgtcatctcctaccaactggtagcagttgtttgggtctttgtgtttagaaggactctgaggccacatcttgattttgtaagaatgagtgtcatattcaatttttaatggctgccatggattctttgaccaaaatatgattttgtggccaccaatccactaagttacatgtcttgcaaagattcaacatgtcttgcaaagattcactctttggccaaagagatatatttccctttaaaccaatgaaagctctagaagctattacgcttgtatccgtataaactttgtgttaggttgctattgaggaaagctgtattctcagttgatgaggtcccagccatagagaaatgagaacatgagctgactctgttgccaatttaagtcaaatacaaaagtatcttcattataagtttttattttcgcattggactttatatttttaaactttcatatcctcaggatcctttaacactgaaaaaaccactagtcttcctctttgaccagcagaaactataggagctcagtgagcttcagttagggccactccagtaggccctgctgccccttcagacaaagcagtagaggaaatgagggtggggaggggctgcaccaaatgatctgagtgactgtggacaagttactcattgtgagacaagaaactgagaagtttcttgtctataagatcagggaacagggaattaagttccatcatctcttaggacttcttccacagaaacattctgggtgctaccaattctataaggtaaagcggaggaaaaggaaatgagatgagaataaattattaaaagtaagtaaagtggacaatggaaagaggagggaaaaaagggaaaaatatatataaggataacaaaacactcagaaatatcattcagagattgtatccttggtaagttacagatagaatgccaatttccatgtgtattttttttttaaatcaagatttatatctaaaactttttgttaccaaatttttgggctgatgatggtatcactaacatgtcaccaatttttctagatgcacactaggtacagaaggttaagttaatcatactcctaggtgcatgagacactgttaccattgggccacaaaagtagcagattttgtttatctattaacaaatcagtaggaacaattataaccagctcacgagaacttggatttggatatatcctgaatgacattatagctccttaaagggaacaacaccggttggcaaaagcctggtatcatagtagtacctgcaatagatgtactatatttctacatttccttgattctaaactgttccatcaacttaccaatagctttccagtgccatccccaaaagagaagaaaaagaaacacaatctcgcattaaatgttcccataggcacactgtaattttagaaatgtttaaatgagagaaagtcttaagttgacagaatgtcttaatattgaagcaataatgataggtatattctctggtatcagcattatgctataatctaagtttcacaatttttaattgtctaacttctaaacatctgtcctctaaaaaatattatgcaagctaaaacagactgcattgtcttatattctaaacatcggtgtctgatcatacacccaaaatcttgcacatttctgccctaagacagaaggacagaacagggcattacttgcctttccaggctcgcactccgtcccatcggcccagggtgtgtgctgagtccggcagcctttgtgtactccattgacgttattgcaccagagccgtctgcactgcatctgctcaattcaatgaaatggcaattgagtgacaagtgatttatttggcagtatcaaacaaagcaaagcttgctttcaactaatgtttcaccaatgacatagggtaagtggggaaggaaattcttttcttggtatgataaatgctaaaatatagacagcagcccataaaacacatttctatccctggtaatggatacccatgtacccaccaccaagctaaggaaagaaaacttcacagacacagctgaaggccctatgtactcatcctaggttcctttcccttccttttcctaccagaagtgaccacagtcctgagtagtgttcatcacttcatcatttccaacacttttactacaaatgcatataaatctccagtaatagacagcatttaagctttacaactgcaccatactgacatatcctacaacttgctttcttcctcctctaaacactctgttttttagatctattccatttgctatatttagctctatttcagggcacaattttaaaagattttttatctttcctaattattaaaataaaccacacttatagtagaaaagttgcacaagtattaaaagtttatttttttaaatagaaaaagtttcaaactacccagtcttttctgtagctttttctccccttttagagttgagatcatacttcataaaattgtttatcttgttatcttaacttaaaattatagcaggagcatgttcccagatgtagatcattttcaattgctataaaagggagaccctataatttgtttaacctttcttttgcttggcatttcaatgactcctaatttttcctatcatgaataacacaaaaacaaatattgccatgaatcaagtttactcaaaattttgttattatttccatggaatactattgtacttctcaattcaccaggcaatctctgaagacactcccagcaaaagaaacacacatacgccaccccaaagagacagaatgggccaccccatagaaacacagctctgctcatctgtaaccggataactgctagatgttatcactggcccaaacatccacaacacatgcagcaaaactatcacacagccaccccagctgaggccccaccagaaatgatttcaagccccaggtggtcacaggatgctaccttgacaagctaaaacacagaaacatgtttgtctcatgaattagctcttctgaatctagaagagtccctataatttaggtcacctggacaagtcgaagggcattaaaggcaacaaggagagaaaaaagctgagctctgtaattcccaactccgtaaccttgctgcctctgagcctcactttcacttgtaaaatgaaagtgatgatggcatcttccttttggactgtcacgaggatgaaatgagaaagtgcaggtaaagcactatttaacactgagcagcagtactgttgtgtcatcctcataattattatgatcactaatatgcaattttactctcagcttttccttgggtagtttatagtcgagttagaatgcaatggaaaactatgaataaaaagaagtgcagaatcagtagatgagggcagaagtggccctcctacacttaccatatatgggcacacctgagaacctggtccaaaaatcaattcacattgtttattcacgttgtaaaggatgcctggcagttggacaggcaaagggtagggtctggattcaggttcgttaagcaaacactcgccataaccagtgctacggaaacacacagaaacacacagatggtgagaacggtggctgtcaaggtctcccccaggtaacagtaaaggccaccccaccattgtaatggtagagaggacagttactttttaacatgtgctttattctttacatccaagattaaatccagatgctgaagttacatttttgctgtttactttgtagaaccacatgcaatgaatacaacatagccagtaggaaatatacacctgttacaacgttgatcacacttcacagcaattatctgtttatgtttgactatctttcccaatagactgtaagctttctaagggcaaagatagtgtctttttcatcaaagcacagggccctgtccatgacaacaggtgattagtaaatgtttgctgaagggatgcgtgagcgaatcaatgactcatagaaagaaaacaccttacaccatctggttaaaaagaacaacagcaaccctctggttctttccgttttcagcaaacacctctcccggaaaattcacacccgttgagttctgattgataaagcctcctcttccccgtggttgcagaaatatacacccagtgactctgggacaatcacttaacctttcatacttctgagcgagaagagcaataaatctgtgacacaggggcattgtataatgtaattggatctttgagcagcctagcaggaagcttaaaaaacaaaacaagaaaagaaaggaaatgggaaaaaagagaaaagggagagggaagagggggagaggaagagtgacgcagagagagaatgtcctcaactcaacaatgtgggagctgctgtaatttccactcatccacggaatctgctttgggatcatctcactaccccaccccttttcaggcccaaattactaaattagaagtgcataaatacctgtggccttcattaagaaatcacattcatagtccctctcccaatgtctgaacaaatctcaaaactttacccaaaatgaagcaacatttccacatcctctttaagactccaaccttttctttagctcagtctgtaatcttctaaactctgtcaaggatatgaactacacagatgtcagagagctttttttttttttttttgccttctccaaggaatgtcaacaaaaataactcaaaaggaatgtttgacttcatattgtctttcccacaattagttcactacatgtaggccaggcactagaagtttgtgctaaaagaatgttcaagtcttactctaaaaactcagtgatatattttcgactacactttgaccacatccaggggttggtgtagaagttcagtgttggagccatgacatgctggggactcttaactccttcttctttacatttgttgttgtcatcatgaggcatgttaaacctaaagccaatgagacaatgatgagaatgtcaataaacaccaagggatcatgctgttctaattgcttcaggaatgcaactatctaagagaaaaaaatttaacttcattttggataagaacctgaaccctggtaagcagaataaaatgtaagacaattcaagatagagtgtagattaaaacataattctcacccaacttaatacgaagtgtaaaggcataaaatgtattttaaaagatgcaggctggcccatgtatttggtttaagtgtacttttaggaattgcagaggctctgaatatgctgtagttggtgctagaatacagtagttggaattcctaataagctgttaaagggcaatttatagagtcaagaatttggcagcttatgataacgtgaatataaagagtcagggaagtgtcaaaaactgaagccaagagctttctaataagaggctcactatgggtcttggcatcttcccctttttggatcagggtgacaaattatatacctgcgtaggtatatcattctaaaggcatgcaaagtttgtgcacaataaaacccatgaaaggtagtggtatgcatggaaaccagaagcatgccaattctactggcataactcagagatggcaaatagtttcatgcttcatgccagcaccaattgattggtactggcttcctgaaaagccaggcacaaaagggttcttaaattaatccaggttccgcctgtgagaaggctatgaaggattgccaacgtccttatgggcctggaagggaatgcagcagcatgaacacatatttgccattcttggcttagccagcaggagtggaaaaaaaataggaagtatttcctaaatccagaaacaccaattctgtgacccacatgccattctcagctcaggcaattatctactgggtgacaacctcagaagggtcaccttccctctctctggatgactatccccaatgcatgtaattaatttagcattgagagagaaattcccttcactagttcatcttgattacagaaataagtgagtcagacagaagcacatagacttgcatcatataaaagttggaataaaagcctatggagtctattccattaatttatcacattttccctttttctttaaagtttatgcctcttaatacttgccaatagagacagaaaaactcgatcttagttgaacttagaaatagttcttaaaacatgagactcctatgcttaagaatctattttcttaaaagaacgaatgccttggtttccagttccctgatgcataatcaatgcaatacctgcatcaacaaacttaaaacaagcaaggcattcaaatcttagtggtttctttatagtggtgtttatttcccatccccagatgaggtttattccccactcccacaattacttgataaagtcaagtttattacctcatgtaaataagctgaaaatttattttcattcaaatgttactcacatttgctcactgcaggagttaaataataataaatgcttattggacgcttacgaacgataataaccacaacttttcagcattcacaatgcaccagaaaatgtgctaaatgctttagatgccttatttcatttaatcacttattttacccaatgaatagtacaggttgaacatccctaatctcaaaaccccaaatccaaaatcctccaagacccaaaactttttgagtgctaacctgacaccagtggaaaattccacacataaatgtgtaacacaaactttgtttcatgcataaaattatttaaaaatatcatataaaattacctctaggctatgtgcataaggtatacatgaaacataaattccttgcttaaacttgagtcccatccccaagatatctcattatggatatgcaaatattgcaaaaatctgagacaatccaaaatccaaaacacttctggtcccaagcatttgggtaaggaattctacacctgtactgttattatctgcattttgcagatgagaaaactgagccacagagagctttaattacttgatcaagtcccaccgccactaagctggggaagctggaatgggaattctcttcaaggcttccttgagtttcacaaaagtgcctcagaaaccacgaggatagagacgatgctgactaagcaggttgggcctgccacaaatgcttaatggaaagccagacctcttttatgttctaaatatgaggcatttgactgtatttcctctggagaaaagaaaaggggtgtgctcttaatatatgtttgaaaggtactagtttaaaaatatacctgttatatattgagctaaattggagacacctgtgtatatgcatctccctctgtgcctcgtacactacactgcacataggggaccttaaatgtatgaatgaaaatcttgtttaataaatgatgttagctctaagtaaagttaccatctgccacacaaattgatctattaatatcctttcagaaaattatttcgaaatagatagtataagtaatttaatcatcctagaaagaaaataatgcagatcaaaactcagaataatttctagtcaatttgcagtgttttgccccatgttctaaccgtgctctatctctaaaaaacaaaagggaaaggccatttcataacggccacttagtgaccataattaggaaatgattccttctttctatctttgttcattctctttcctgaaaaaagggatactactgttcccagtgctaaatatcagaattagagcagtgtataactagaatcgggaatggtctggatttgtaaaaatcttgggggccacagtaatggtgggggaccctcctagacaaaggtgttaaatcaggaaagttctctaggctaatatatcctctgcttcagtagaaggaatggaaagaccccatttctccagttcccagtaggaagggagaatattagaccttgtgtattaaacttgagcagttaaactgaagatacacacaagctatgactaaagagagtgcactgcatttactcaacttttggaagtcaaagtcatttcacctaattaggttcaaagctcttcaaccctgcaactctactatgactcgggaagtctcttacacactcgaaagtcaagtaaatgctcactgatgcgaaggaataaaaggtttaggtcactccaaattaaatgaaattactgaaaggtaactcacacatggcccagctcatgggcgatcgtaaaagctgtactcaatccactatcttcactaatagaacagcttctatagggatcacaaatggttcccagttcagccaggcctattagaaggaaaaaaaccaacaaggatttactctaaaaagcaactgtggcttgaaatacaaacatgtagtaaaacggttttagccatagaagatacgcacagagaactcacctaaggtatcacatttgtcgtgagctctgcagatatcctgtctgaaagcaaagcagacttaggccttgatgacatcaaagagtaaatgtcaatacaagtaaatactttagggtcgtctaggcattcacaacagtacacactttggggtgggggttaaaaaaagcaaattcataagaccagagtttcaaaactcaaaaaatttttggaattgttgatttaagaattataaactactacattaagaagttttcttctgtggtcagggcggtcacagagcagtaagaaatctctccaaccaggattttcccaataccctggggtaaatgattccagtttcgtaaagactctttgagaacattcctgagaaggtgcaagatacctttgttttactttcatttaagaggacgtgctcatgaccacaattgagatggcaggaggtgggaggcacaattaagccagcacgcgtctttgttgctacagtgttttaacattttgagatagtagctaccatagaaaacttgggaggtttcacatttttaaaaaattcatttttctggcttttgcaaaatcacaaaagctggcaacactgaactcatatactacatggcaacgccaggtccatctgaacagcagctgcccttgcctgttatataaggcatgtattttcaggtctgcctaacacatttattcctcacttggtatctataggttcgtggttctcaaccaaggtgattctgccctccccacggggggcagtggcaatgtctggagacattgctggttgtcacacctgaggggagggagtactactaatacgtagtgagcagaggccagggatgctgttaaacatcttgcaatgcacagaaggaattgtccagcccaaaatgtcaacagtgcctaagctgagaaaccctccactagcagctgactattaggaatgcatgaccacatcccatcaacttgacctgagactgaaagatctgaggaataagaaatccatataccttgttaagagaacagcagtatcatgatggattccacctggactgttcttcgaatgctgccactggcaaaagttttttaatgttgtctgagcattaaaagatatggaaggcccatcctaaatacagagaagaattatggttaatctgttgtaccgatcccaattagatatgccatttcggatacagatagaagaaaaaagaaaaaaactttattacctgttcattatgaatcacaattaagttcacaataacaatattaattaaatttccaatacttgggtctttatagatagaggctacctgcaaccgagataaatttttcaaagttaattgtgaactccgtgtaagcaataagcaagtcacgtcttacgttgggctccacctcttttttacgtttcttgcaacatatgcattttgtggttgtgaatttttcattcactcaacaacactttttgtaaagtctcttcataaaattcatagatcacagttttagataacagtgaattcaaacaaatttaaattcctctgaaattgcattgccacgtgacttaacagttctctgtaccagaacactggatattaattttccatcaagctctttcctctcatctgaagtcctggattgccaacttatagaatctcacattgggtgcacgttagccgacactgctattctttaatgtttgccacccattgtgtccttgacaacctcgttaacctggtggggtttttatttttgcagtattataattaattataggagctaacatttactaaatgcttattgtgagctggctgaaaactgcatacacacatgcatttagtctctacacagcgaaactctgggctgaaaactaaatacacaaatgcatttagtctctatacagcaaaactctgggctgggtactattaaaatttctgttcaacaaatgaggaaactaagtcactcagagaaattaagtcacttgtctgaggctacacactggtgagtagaagagccagaactctcaacctagggcagtttgacccaaagtccatgttcataatcaaaattcttaggagagaactgaaattaagaggtgaaaatgaggctgtgcatatgcgcagggcctgattagatgttcccttccctcatgggcatgagagggctggagtatctgggactgagcggcatgtgggggtgagaggggcacggaggccaggcagggttggggggcgcagaggggaatgggtcacagcagtgaacaaaaaggcaaggagtaccataggccacaaggggggaagaagaaaccctaaagctatgcccaaacaggattgcttttcacattcatctgggggatttattaaaaataagtttcagttcaggtaaatcagggctcgtctattaaaagaaaagttatgctacggctgaaaatgagaaagaggaagtctatacgggcttttctggacccatctcgaatcgttcaaaaaaacagcaatgtgtaatacagtatgtgaaaatgcctcctgtttgaaaagaagctgtatatgcgaacatgtttgcataagaaatacctagagttgcactgcccaacagtggccacccatcacaagtggctagtgagcactagtacgtggctagctcaaattgaggtatgctgagagtgtaaaacacactggattttgaagccttagtataaaaaatgtgaaatatctcattaataatttttaaaataatatttgatataaaacatattgctaaaattaattttacctgtttatattttactttttctttttgaggcagggtctcactctgtctccaaggctgatgcacagtggcgcaatcaaggctcactgtagcctcaaactcctgggctcaagagattctctcacctcagctcccgagcacctgagcctactataggtatatgccactacacctggctaattggtttttttttttaatagagaccaggtcttgctataatgcccaggctggtcttaaactctgggcctcagattatcccacctcagcctcctaaagtgttgggattacaggcatgagtgactgcacttggccattttcttaaaaactttttcttttaatgtggctacatgaaaatttaaaattaggaattttttttaatttaaatacatttgaaattaaatatgtggtttgcattatgtttctattgggcagtgcttgttagaaacatatacaaaaactttcaacagtggctgccactgggaaggggcctggaagtctgcatagagaatgatacttagtttttaacaatagactttggttctgatttttaaaaaatcgtgcaaatttactgtggttttaattcaaaatgggagtagaaaaatagaatgaaagcctcctaggcctcactccccaggctacttaattagaatcctggggaagaggctatttttagaagttccacaggtgactatggttcacaaccagcctccctaatactactgaatatccacaactggctgtacaaagttcctaagtgaggcaaaaagcattggttttcggaactggacaagctaaaggccacaggcagcgtccaagtgatttatgagtgatttacctgaccatgggcaagtgacctaactcctctgagactcagttttcttatctataaaatgggcatgattgataatctcacctggcagcgttgccagaaggattcaaaattataccttttaagtaagaagcacattgtctaacacagaataaacactccgtattgataaccactgttgtcagtttaaaaaggcaaccaacaaataatcttatgttctcttcagtcacttgcctgaatggctgaaatgccagttctgaatggtcctccaaagcactgagtggaaacccattccccaatggcacatttagagacctcataaatcaccttcgtttgaatgtacttacaattgacattaaagttaaaatatagtgttgaaggttttctccatggtatgaaaccattctgttgtctgccaccaccaagacttctacaaaccgtggataggataaaaaacgttttgtccttctgtgggtcctcttttctcttgtgttgtccgtcttattaccataagcagaaaatgcctctgttgctaagccgctgtttaatgctgctacgtcaccagccaggttaatcctttctccccattttcttgctctggttttcttcttgtctttactgtgcctatttttgtgttctgtaacaaatcagatggtatgcattacatttcaagccacatctattttatattaagaatttaatttgacacattttaaattgatccctctgtggtcaaactacatacaaaaacaagtcctccatggactctacagatgcacctcaatccgtactcccacctaagtgactaaggatttgagattagcttccctgggaagctttcatacttgctcgcttacggtattagaaaatcaggcccgagcttaagggaaacaattgcacgtgattcttattcatttgttaacaaaagctttgctgggattgattcaaggaatctcacgctcactgttatttgccatagatatagtaagggccagtaacgtagctacagagctctgaaaaacttaaatggaggctgggcacggtggcccatgcctgtaatcccagcactttgggaggccgaggcaggtgaatttcatgaggccaggagtttgagaccagactggccaacgtgtcgaagccctgtccttaccaaaaatacaaaaattagccaggcatgctggtacacgtctgtaatcccaactactcaggaggctgacgcacgagaattgcttgaacccaggaggcagagcctgacgtgagtttagattgtgctactgcactccagcctgggtgagacaaagggatactctgtctcaaacaaaaaaaaaaaaaaaaaaaggaaatgtttcatatatatcactcctgctattcaatgagttctaatacaaagaggtctgagaagtggacaggctaacagacgatacagaggaactgtagaaaatgcacaaccaggtattttattacattattagatcatttcaatacttaaaatattagaatcacagcaattcaatgtctctgaatttttaattaacttactccagggctcagttaaggaaataaattaaactccgagagtctgggcaggcagctgggaccatgatttataatgtcagattagctctactcatttccagctcatgcctaggcctcttcttgggttctccacagtcttgctgctcagagtagggtccgtggaccagcaaaattgacaattagaagcttgttaaaatgcagattctttggccccaccccaggcctgaatctaaacttaactagatccccaggtgactgatattaacactgaaattttgagaatcactagtttccaacttggcttgaagtttatattactgatgaaaatactgaatttttgcatcatcaactatgcaataaacagaataagcattaaagtgcctgccaaaatatactttgagtaaaaacagaatttcatcagttaacttgacaatcagatcataaatgtgctttaatgctttaatgccaccagtttgtggtctaaaataggcaacagaattgtacaatgaagaagtatgcttacctaacacataaggaatagaatttgttacatcaataccaaaggtaaaaataaaaattaaaaacagttaaattttaagtggtttcatattagaagggcctaaatatttgaccattataaccaattgctaaaagaatcagtttaggccaggatgtgcattttgcctgagtgttttagtcattattaaaatacagtggtcccccctttttcatggtttcggttcccttggtttcagttacctgcagtcacctcagtccttaaatattaaatggaaaattccagaaataaacaattcataacctttaaattgcataccattctgagcagtgtgatggactctggcactatcctgccccatcctgcctggggctggaaatcatcctttaaggtagctatatacacaccccaccttgtcacctagtagccattccggtgatcagatcgactgtcaaggtattgcagtgttgtgtttaaggaatccttattttacttaatgacagcctcacagtgcaagagtagtgatactggtaattcgtattaagccaaaaagaagctgtaaagttcttcctttaagcgaaaaggtgaaaattcccaacttaataagcaaagaaaaaaaaacgttgcatgctgaggttgttaaggtctatgataagaacaaatcttccctctgtgaaattgtgaagaatgaaaagaagctggtgctagttttgctttcgcacctcaaactgcaaaagttacggatacagtgcgcaatcagtttatttaagatggaaaggcattaaatttgtggttggaagacaggaacagaaactttctggctgatggcaatcagattggtactatgtgtggttttagacatccactggggatcttggaacatatacaccaagggtaagggaggactactatagtaaaatctgaacaaactgtcaaacaagttttatgcagtccagttatagataatatcgctagccaaaaacctggtacataagatgtaacattagattcttcttctagtttttctttcaagaacactcatatatgtataccaatgccaataagtattgcatgtctaccaactggcatttgtatacatatatgagctttcaatatatgcataccaggaccaaatcaattgttaaatcatcaaatgaatgtagactagatattaaacaagcacctactatgtaccaggcattgaattcggctcttttatgtatgttatcttacttactcctttcaaagtgagaaaattacctgtattttcccgatgaggaaaataagtctcaaagaaattagcaacttattcaaagtcacattgcaggaagtggaggtacaaggaatcagtcgtagatttgctcaattcccgaaattgtgctctttcgattaggtgagctttctcaacagctacggtttgaaatgagctcatgatttggtgaacagcttccaaagtaaatatgaattgagaaaaagacagtgcctggtggatattttcacgaagatttttgctttttacaacaggtgtatggaagctatgttgaaaattaaatttttttaatacattaagaaagtatatcacttatactgtgaaaaataaatagtccttgcttaatgtcttctgtaaatattacaatttgatttattatagtaagtaaagtgttagacattttagaagatttaaagtctctattagttttctatttctcatttgttgatttctgctcaaatctcgatttcttttcttctgcttgctttagttttaacttgctcttttctttccgttgccttaaagtagaaggttaggttattgctttgagacctttcttctttcttcatagaagtatttacagctctaaagtttcttctaagccctgctttggcaccatcccatgttttggtatgttgagtcttcattttcattcatctcaaaatattttctgctttctcctttgaatcattgttcatttaggagtgtgctgtttaatttccacatacttttgagcttctcattttttgtctgtaatggatttctaattttgttacattgtgatcagcaaatatgttctgtattacttttatccttttaaacgtattgaaatttgttttatgttcttgcatctggtgtgtgctggagaatgtttcatgttcacctcagaatactctgctgtttgtggggtaacgtgtccaatagatatctcttagtagttggtttatagtgttgggcaacttttctacttccttgtcaatcttctgcctggctgctctatccattattgaaagcggggtgctgaagtttccaattattgttgttgaattgtctatttgtccctccatttctgtcagtttttgctttacatattttggtgttctgttatcaggtgcatacatgtttataattattatatcttccttataaattgacttttttatcattataaaacactttgatggactttattctaccaggaaagttaaagaagccagtcacaaaagaccacacatcaaaggtctccagtcataggaaatgtctaaaactgggaaatctacagagacagaaagtagagtagtacaagttgggtatcccttatctgaaaaccccaaatccaaaatgctccaaaattcaaaactttttaaatgctgacatgacaccaccaagtggaaaattccacacataagtatttaacacaaactttatttcatgcacacaattaataaaactatggaataaaattgccttcagccgatgtgtatgaggtgtatatgaaagatatatgtttagacttgggttctatgctcaagatgtctcactatgtatatgcaagcatcctaaaatccaaaaaaacccaaaatctgaaagaattctagtctcaagcattttggacagagatggagtggggagatgggagtgtggttagctaaaaagtacagattctttttctcaagtgataaaaatatcctaaaattgactgaaatgatgattatacatatctgtggatataccaaagaatcattaaactgtacagtttaaatgggtgaataatatgtatgggacttatacttcaataaagctgtttaaaaaagagaaactatatcactaagtttgtgaaaagtaaataatccttaatgttttctgtaaatatcatgattttatttattggatttacttagagaagagtactgcagtgagaacaacactcaggaaatgttgtatggaattctttttttttttttttttgaccactaaggggaaaaacaaatgtactatcagaatcatcagaggggaaaaacaaatgtactatcagaatcatcagagaggacttgggcacaagaaaacctgcagatgaatcaaggccataaatggaaacaaagtatacttataaataaaatcaaagaaatgaaggcattaatcagaaaaaggctacaatttctaccagcaaacaactcatgtaattgtaatatttctggaggatatttcacccacaagtaatctgtgtatcgaagaaataattcagcatactttaggtggcatgaaaatgtaaaacccaaattatttcttcaggatcaaaagcaatatcttctaaaacagaatggtcctcagtcttttatcaatttgacctttttctcctaatgagttagaatgatatttattcacctaactggtccaactaatttctatcacattaaccattttagcaagcaactttgaatttctcattaaaaatagcattaaaaatagacactatatcttatatacccactcaactctgttgcttctgaatagagttgtaataacagaatagttttcaccaacggagtacacactgttaggataaacagaaagtgatccacatttctcttttgtgagcttttagtataatgctaaaggaggaatagaggctagtgtttcaggaatttgcaaagtcactttgcttacagtttaatcagaacgggctacctaataaaatttcactgtcctggaaagcactgaaaaaatggtctgtgtattcttgctcttctttttttcctcctacgtagttttacatttatgattaatttttaatattagtttggtaagattatttatataccatacaattttcaaagtatgaagttcagtggttttcaggatattcatagagttccacaatcatggccaccatctaactttagaatattttcataatcccaaggagaaatccgatacctcttagcagccattccattctcccctttcctcagcccctggcaatcactaacctatattgttctatttatgaatttgcctattctgacatgtcatgtaagtagtcatacaatatgtggccttctgtgactggcttctttcacttagtacaatgttttcaaggttcgtctatgttgtagcatgcatcagtattccattacttgttactgttaaatattctactgtatggatataccacataatgtttatccattcatcattggtggacatttgggtggacattcaacccaactgaataagaacattgctgctatgaacattcatgtgcaaggttttgggtgaatatatttttgttcttcttgtgtatatacatagccgcagagttgctaggtcatacagtaactctatgtataacattttgaagaactgccaaattgttttccaaagtggttacaccattttcttgcttcttcttgaagttcaaataagacacttcgaaacaggacatcattttttcatgtttctttttctttgagggttcctcaaaaattaatcatgtttacttaattaaatagcttatgaagaacctggcccagctcaaatcctaaaatagcatattgatgcctccaagtagtaaacgcatgtttgcattagaagaaaagtgtaatacttagcaatctgaatcctcatatatgcatctaaataaatttagacgtgtttaaaaaagctctaactggcaactgtatgtttcctatcgccacatcataggtattacagttctcacattttattacaaggacatgagttaatacaggcttttgcaactactttggcgtcgatgctcacaaaagggaagtagtcacgcttacactgccacaaacagccaatgtttgaagaactcatgcaatgaagggagggaggcccgatttaagtcctatttgaccttgggcaaataactgactcctgctcaccctccgtcctcccacttacaatgtggagtaagaacagtacctatttcatagagtggctttgaggaataattggagatcatgcatgcaaagggctagcacagtgcctagtgcataggaacgaatgaataaatatcattatcatatttttctattttttgccagtcacaaagtcataaagtgagttggaactaaaaggaaccatttaaggtagagtgactaagtgtgcttaaaaacaattttctggcttacattaacaatttcaaagccatgagctgtatactcctagtggggcaaatcagcacagagtgtgcctgattgcatttctgacatccaactttttaatactgtgaaaaaaggaggaactacaaaaccagaagtgctgagggctggtcttcaccctactatcccatatgaaggctcttttctgagtcacttctctgggcctcagtttcctgacctttaaatgggcatataaatacttgcttccatcttatggctattttgagaattaaataagaaagcatatagagaatttcttataaattataagttacatttttaaaaaaattcactcgtggaacatcgattttgtgccaagtactgggctagataagttgaaataaacaacagcaatgacaaaacaagaataaaacgtgggtccaatcttttaaaaaaaggattacaaaaatttaagatagtatccttattttaaaaaacctcacagcaaaaaactttaacatctgctgatttattggtaaaaatgttttaaatgagcttcacttcacgttgcaatacaataaaatgcacagtatgttactaaataactggaattatttcagcaaataccagccaggcctcgttattcagtggttactcactgaagtgtttcctaccaaatggggttgggccgaggagatctgaatgttaacattaacagttggaaagttaattattgctctctattttgtaaggtttatcaaaatttaactgagtttcctcaaggcgctgggctaccttgtgacttcacagagcacaggaccaaagggaggattcaggagcaaggcgagacccctttctgctccacccaagcttgacagagagaaggaagtctgcacaggaatcatctgtggtgttccacttggattctggagccaggccaaccctggtttccattcctcccctaaagctactctagttgccctttcttgtgtcatttccttctttaaagcctcagtttcctcatctgtaaaatgatggtaataacagcatactgcaaagagtaactgtggagattaaaagagataatacataaaatgcccttaaagcagggcatgacacagaggacaggtccaatacatatttaacataataataattattagtggtattgttttacttgtagcatgcaaaacatctgatctttataaattagtatattgacattctcaaacaaaacaattttgttttagaaagaatctttgatggggtgcagtggatcctcctgtaatcccagaaatttaggaggtgaaggcaggaggaatgcctgaggctaggagttcaagaccagcatatgcaacatagggataccctgtctcaacaaaaatcaaccaaacaaataatagtgtgagctgttgtttttttgttttattattatttttttaagtgatgtgcccagtgtcaagtagtgctacatgcacagtgctgacagtaaataaatacaaagagtggtggcagaagagattgtggctaagactcactttgggctggcctgaacctttataaactatgtttccatgagagtggtttatggaacattagtcccataagatagttccaaaaacaaatcaattaactttgcaaaacacttaacacagcatgcacatctggaactttctccatgcacattagcattttaagagccctgagaagtcttgcaggaaagaaaccagtttacatgtgctgagtcgcatgattgccaaacttacgggatctttgccaagttaagaggcaagtgatggggacagcaccatcactagaactataacaagacgcaggtgggatgtgtggatgggcttccctctcagggagagaagggcgtgcgagtggaaggcaacaactgagaagcttcttggcttttaaggggcggtggtgggcagtggaaggtgtctgagggtcccctcaataccttctaagggggtgggtgcctccagctacctggggagttaaatttgctgacttgggcatgagagctgggtgcactacccccaaaagcccttctgtgtccttttcattctccattctgtagctccttcaactaagtgtgataacaacaatgactataggctataatcatactggccaacgtttgttgagttgcttttctctgtgtcaggcactctcctaagcacttcatatggattaacttgattattcctcaaagcaacccgatatggtaggaactattaccttcatttcagaaatgaggaaactgagggacacttgaaataacttgagaaaatatttaaagtatctatttgaagtagtataagacgctgaacatcccagggcctgtgttttactaagagactatttagttttgctattaatatcctgcaaagtaccctttaggaaatgttggtttcgattcactccatctcttagcagtagcgggagagtgacctttccgcctgtcagggtgccaactgcccacagacaccctgtcctggctgcagtgcacttgccatggctgcctctcaggctgctttgtgccacggcttggcatctcccaagcttgcactctccagtagaaataaaatgcaagccacacgtgaaagttaagaatttctagtagccacgtttttttaacgtcaaaaggaacagatgaaattaattttaataatagagtctattgaaccccattatgcaaaatattatttcaacatgtgacactagccacatctcaagggcctcctggtgaccgtataggatggtgcattctaggcaggaagtgtttgcagagtgtataccagagacagcgtattacgggagataagagtgtgagctcgggaatcagagagacccgtgtgtaaatcccagctgctctgcattcaatctgtgtgacctctggtgagtcacttcagccctctgtgcctcagtttcctcatctgtgaaaagggaataatgatagttcatgcctaatagggcagtagggaaggtgaaatgacttagtctacataaagtgtcggaacagggcctggtgggtaggaagtcctctggaggcacgggctgtgctgactctcattacttagaatgagcagcaggttaaggctgctggaacgaagtggctcccaggcctgccgctgggatctgcctgctatctgacatttcactgcagctcgtgggtggccctgaagctgaatgtggtgcctgtggtgggtctaggtatcattctcatatcagagattaaagcgcagttgggctggagctctttaaaaaggcatctaagcaactcgtagggagtgtatctcccacattcttttgatacacaggtctcctagtttacaggcactgaggactggtttataaggcctgcagctgaaacccttttgcatcacaatgtccatgttccatgaccacggaagtgagtgaccacaggggcatgctgtgctccaatgaccagtgaacctcactggtcttcctccccagccacaggccaccttccccaataccctggcccagctcagaaaaggcttgattggtttatttattttaaaatcatatttggttgctgtacactcaactctcgatatgacaacttaatcccttaaatgaattgaaagctttctatctttctctataagcttgagacaacttcttgaacagtctcaccagttcattcttaattattcccacacttaaatacaatggcacttcccaaagctcatttgagtcatacttttgaacatcccctttccaggcaccatctgcagcttttccttttgttacagcctggaaagaacacaggactgggaagtaagaggcctgtgttcaattttgccattcattctagctccaagattaggagtcccttcgaagttctgggccttgatcctcttatccataaagagaaggcctggaatagaagttctctctaaagtttcctccagtattaaaaatttatgaattcttatattttataagataaaagtgaataatgattaaaaatgaagtcctaagtttccaaaggggcaaaacccaacagagattccccctgagccactgtcactgtcagaaagtgtatggatgaaacagtcagcagggtggcagggtagaataagacagaataactccaaaagagagagaacaacacaaaaggagtggacttttgctgatgttaaattatattaaggggagtacagtctacacatctccattactcactgggaaaattttatttcggacctgctaaaacagataatagtttctgaaaaaccacttctattttctctaatctgacttgttacaatgaaataacatgaaatgtaagaattaggaaactggcttgaaagaaaaaaaagtatacaatcaaagataccgctggaaaagcatttaaattgtccacaaagcacagaatggaagctttcaggatttatggagttatatattctatccctcttcagcagcagggcatgtggtcataaggactgaatctcatactattaataccaaactcttctacctctgtctctgtctcagtctcattgtccctctggctctctctttctctcctgtctgcatgcacatacacacatgcaacatacatgcaaaacaacacagttgcattcttacctatgcagaggctcccctggacctgttttcacccctgagctaagacaacacattcccatcaaaaagtacactggttggacatggagagttgtgtttctggatacagatgagcaataaaaataacaactgccttttctcttggcctagaccatggctttgaataataaatcctaaatacacctctcctattccattttttgggcaagctctatactgcatgctccactatactttcttgctatgtagttctgggactgcatgaaatctacggtgcatgaagtattggcgataaaataaagaagctatgtatgaaataagcatttgcaaattaagagactttttgaaagacaagccacaatctgggagacaatatttaaaaactatatctgacaaaggacttatatacagaataaagaactttcagacttcagtaataagaaagcaaatattctaagttttaaaaaatggctgaaagacttgaacagacgcttcaccaaaaaagatacatggatagcaaatatgcacatgaagaaatactcaatatcattagactttaggtaaatgcaaatgaaaactacaatgaaattccactaaacacctattagaatagctaaacttcaaaaaacaaaagcagaacaacaaaatgttgacaataccaagtgctggaaaggatgcagaggaactggaactttcataccctgcaggtggagctacaaaatggcataaccactttgaaaaatatattggcagtttctaatagagtgaaacatacattaaccacacaagccagtaatcttatgcctaggtatttatccaaatgaagtggaaacttatgttcacacaaaaatctgtatgcaaatgtttatagtggctttatttgtaatggtcaaaaactgtcgctcaagtgggtaatggttaaagaaatggtgatatatccattcagtggaatacagctcaccaataaaaaaggatgaaattactgatacaggcaacaatgtggatgaacctcaaacacactgtgcttagtgattatttatatattctgcaaaaggcaaaactatagagacagaaaacaggggtggggagaggggctgattacaaaggacaccaaaaactgttctttaacttgattatcacgatggttctatgactgtatacatttgccaaaacctgcagaactgtatgctaggaagggtaaatgttacagcatgtaaattatacattaatagaaaaatggaaggaaaacactaggaaacacgaatggaaaataaaaagatttttcaaaaaataaaaaataattagcagaaaaattctcaagccaataacattaacttgaactttttccacacagcaactgcatttttaacattcattctaattctaatgtcatataggaattgggaatcaataaaaaggaagacttgtgccaacatttgcctcacgtttgactttgctccttctcaaagcccactactcagtcacatgtgcataccacatcagatcttgcatttacccatgctctttttgtgatattcagattatttattaatgattttcagttgcacagaacatccatgcagatatctggtccacaggtaaaaagtcaaatgagaaaacacagccataaatggctataataaagactcttttatgatacaattatcataaagaaaccatctttggcagatacaaaggtgcaaatgttaaacctcaatgcatgataaaatagcactttattaaccaaagtgggcttatcccctcatatgaagaaactcaagaaactttgccatgtcttactttgaaaagacagcctactcaagtgaaaggtctgaagggttctcaggttaacaccaaaatcctcctgcctctgtcagctagatggccctcttccagagtcttctgctgattctgaagtcccttctaaagaaagatgtgcgtcttagccagtttcagatggttcctatgaaggtgaacacattatcaagtattcacccttgtagcaccccttttcttcagcagggaatgggtttctgaagcaaagtgtcaggaatccctaaaatatgattagcaagaaacagggaaaggtcctgagatggcacagaaggtgtaaagcaggcagctcttctggctgtctttggatccagaagcttaattaaaaagttttaggggccaagtgtggtggctcatgcctgtaatcccagcattttgggaggtcacagcagatgaaccatttgaggccaggagtttgagacaagcctggctaacatggcaaaaccctgtctctactaaaaatatgcaaattagctgggtgtggtggtgcacacctgtaatctcagctacttgggaggctgaggcacaagaatagcttgaacctggaaggtggaggttgcagtgggtcaagatcgcgccactgcactccagcctgggcaacagagcaagactctcaaaacaacaacaacaacaaaggttttggggaatacgcatatttcatatgtcaatgagttctaatctcaggtacaaacctaacttgccaccttacaatcctaattgcaaactggcccttctgggcttcaaaacacaggtgagggagatcctttaaggatagaaaaggtagtttaatatttcagtccatgatggaatgcagatatgacagtggtctcctaagatcgtaatactaaatttttaactgtaccttttctatgtttagatacacagatacttaacatcacgttataattgcctacagtattcagtacagtcacatactgtacaggtctgtagcctaggaacaataggctatgtaccacgtagcctaggaacaataggctatgtaccacgtagcctaggtgtgtggtaggctatcccatctaggtttgtgtcagtgcactctgtgatgttcacaaaattacctaacaagaatgcatgggtcacacacaccctatgcatgacggcactgtaaattgaggatcttcctattgataggaacatcacaatgacagccatcaaggcacttcagacaaggagtcaaaaaacctcccaaagatactgcctttcccttcaattaaatcactctgagaagtggcttaatggcccaggggctttgctctgggtacctgctctggccttgcagactggccttgcttttctaatccttgcaactgcagcctgacctgatgatgataaagatgaagcaaagagtaggggcaatggaagggaaaaaggggctatatgcagcaaatctcaaactagaacgaaaatagcaattttaacaacagcgatgacgacaacaaagtgaaaagttgcgtaagagacaacgatgagttgcaatgtgtggactttgtttagatcacaatctaactgatgattgtaaaaaggcattttggggacaatgagaaaaattttaatataggtactgtgtaggcaatatgaaggaattgttaattttgctgaaacattatttataatattacttaatattacgtatcaaatattaataatattatagttacttaggaaaagatccccacttttcaaagatttatcatgaaatatttagagatggtatcttgagtttgttttaatatactcagcataaagaaaaataagcaaatgtagaaaaatcttagtcattattaagattcatggtgtttacagtggttcattttattattgtctctagctttatgtatgcttgaagatgttcataataaaatggtttttaaaaacaaaatgataatttttaaaaaaatttaatgaataagtgggaacaaatgaaagaaggtacaattcctgtattagaagtttcttttttactacctcttaatgactttattggagtactgcactattaacactaaagtttttttttaaaaaaaaaggaaagcagaatttttataagtaccattcagtagatcaagttgaagaaataaagaattaatgtatttaaaacagtgattttctaataatttaccaaggattttagaggtcattgcttatattgactgtttattagacagaaagtcattgaagactataaaaaagagaaaaaaatgtataaacaccgatgaagaacaaaaaggggaaaatgaaaggaaatcaggctcaaaccataaatcccaaatggcaataactaactttaaaaattcataatcagtcttgagttgcagtgccagctttttccctttctgcaagctgtggacaagtttgttcacctctctgagttcagctttctcatttgtaggatgagaataatcagagcatcttcctcccatgaactgttgcaggagtaaatgaaataaccataatgtgcttccacattgccaagtacacagttccttaaatgctgcctgttcttgatctttacaaggctgaaagggtctaagaatgcagaaagtgtgtggtgaaagtgcaggcagacaagttcctagcataagtcactaattagccaccaaccactgacttgcttggggcccaggcaggattctgaagtcagccaaagcttccgtcactgcctggaacccataggctgccccagaatgttttaccgaaagccccctcaggggtctgctccccagctccgtctctcactccatttgggtaccactcgaagggcagctaatctaatcagctaatctatgctaaattattaatgggatccaagaggttaatgtgtaacaagcatacactccatcagaggcctgctggagacagacacaaggcctctgtgagtcattagagtcttggtgggaatttcaggcaccaagcagccttcctcaaatcaaatcaaattccagacaggcatttaaaaattcctgccagcaaaaataattcatatatgaatgcagtcaaatcaataccgaggccaaaaaatatcccctaactagaccaggacataagggctgaagaaaatggtatgttgatgagctttataacctcaggcaagtcaacattacagacttctctgtgtctcagttttccaatctgcaaaatggagtttgcggtaagaattgaaatatgtaatccatgtaaagttgtaaagtgcctggaacagaggctaccacataatacacactcagcaaatgtcaactcttattagtatcatctagggaatggaaattagatggtagtcaaagaagatgctccaaaaatgaagttaaaaaggggtttgtaggccaggcatgatggctcagtcctgtaatcccagggagattctgtctctacagtttttgttgtttaattagccatgtgtggtggcatatgtctttagttttggctacttgggaggctgaggtgtaaggatcccatgagccctggaattgaaggctatagtaagctatgatcgcgccactgcacttcagcctgggcaacagagtgagattctgtctcaaaaaaccaaataaaccaaaaaaggagtttctatatagcagtttccatttgtgttttctatgcaatttggcccatagtatagcacattggaaatagattgggttaaggctcagactctcttcttcctggctgtgtgacattttggacaagtttctcaacctctttgagctaattttctcaactgtaaaataggggtaataatacctaccctacaatgctgaccaatgtattacatatgataatgtgtgtaaagtgtgtagcatagtgatcccatatgcacataagagcctaacagatgatggctttaattatcatcttatgttttccagcctttataactgcagcctggaaatcccaatcaggaagtgatggtaccttctaatgggagtgataaacagagtccccagtgcctaatggagattaaatcttaataataccagggtcagtccaacaggcacaaggcaatttagctgggttgaatgagagattcaactttaaccagccacagatgtcccaaagaagtagacacaaggcaggatttttatctgtctggttattgagactgcctcattccaagaaaataaaggaccgataatctccacttctaaggtcctaagatcctaagagaccaaaatgtggcttggctattggtctccagtgacaagttcaataggtctagcaaaataaatccatgccactatccctgtttcattttatctgtattttctgattatgaaactatcaaagaaacatgcaaaggagtcacaaaatagaagaatataaaagttcaaaagtaaagactgcctatgttcctagtaaccataaataatcactgttaatattttcatgcctttacttcagatattctgtttacacacatgtacccaaatagagtttatcattaaaaaaaaataatatcctaccaaacatattagtttatcacctgcttgttcactgaatatatattctgtgtttggtaacataaattcaggccatcatttttaacagctgcataggaatccattatatgcctgccccataatgtattgatctatcttcctcccaaagggcacttaggctgtttccaggcttttgctataataaacaacactgtactggatctcgttcataaacacctttacacaattgtctgattatttccttaggcacagcattgatgggtcacagagtagacagttcttaaatgccttaagaaacaaaaattacctggccttgctgagatgggaaggtgagggagaagtttgagttagagaaaaacacttgccttccaggcccaggcaaacaaaacagccttcttccctgcctttctctcacccacctaccaggaagcactgataagaaccactaaatcctcttgtgcaaaattcagggtcaaatagagagtgtccgtgaaacagaacttgggatctcatctggaaacaagcaatgggaaggatccgcaggaagtggcttataaaagcaagccactctccaaagggctcccataggccttttgcttgtgcccctggtgtgtggggctagcaggcagtgagcacagtgaattttactgaggacccagtatgtaaaggacactgcagtcacaagggcatgccatagggagagaagacaccccacttcccatcgtgaaccctaaagaactcacaaataggatgaaaagacaaataaatgcagagacactcaaatggcccaaatgtatacacatagacataaccagtgatgacaaaacagagacaatcaggaagggcagccactgggccaagagaaacttgcaagaaagaaaatatttaaatgttgcattgggtacagaggaaacaaggggacagaaagcaccctcagccttgctactagctggcagggtgaccttgggcaagtcccctaaacccttcatgattacccagaagcactgggctattacctttgaattttagtatttggagttttcctttcctcattgtggtgttttgttttctattttcatgaaccttaaaaaacacctaccattctgtgattgtctaccacatgctaaataaacactgtcctgggagctttcattatttcatactcatttagccctaacttcaatcttgaaaggtacatgttatcctcactttatattctaaagtgtgcttgaagtcatacaactaaccaggaatatggacagttcctggttttctcctcctggcacagagaagttgctcaataaagacttgatggctaactgaataaatgcacgcatgaatgaagaaacggaactgtagactcctttctaaacccataaagttttcattgcagtagactccttctatgcttccctttttaacataagttatctcagaatccttttttgaaaattaggcatacctcaagattcagaaatgaccaagacatattccatctgcgtgtgaaagtgtcacagtcattgtgtcttgccctgctcctactcccatgatctggtaactaaagggttacactgagctcagcaggagacctctctcccaaggctagggaaggttcggatgggttggtgttgaatatataggatatcactcctgggaggaagcatcttaacatcctgcaacttcagtttccttatctgcacagaattagattgttggcctagacaagactgctaaggactcctccagttccagtatcctatcatcctatgagaagaggagacatggaaagcactgatgtagaaagtcaagtccacagcaatgccaacagcaagtgacagataatgactactgccttaaacccaactttagcagtgactctcaaatttagctaaacatctgaatcacttggagcactattaaaaccactgattcttgcttcatcacatttgcctgggagaggggttagttttgttttgttttgttttaaagaatctgcatttgtatgaggctcccagagtacttctaaaggtcacttttggttaccaaccactgctcttgattgggggttgggagggaagatgaaccactgaatctgagtggattgctattgctaggcagccccttttctctctggcaagagggactactcccacctcaacctactttcactccctgtgcaaaggctacctggttccagaggtgtccttgacctgttggtccattcctctgatacctgctggtgaatcgtgccatattctaaactgttctgagaagctgcatctgaattcaaagaaggggtgcagaagtagctggaagagagagaccagagtggcacagcccagcagcaacctttggaagagctgatcaaaactgctgggctcctggttcattacaagggatgaaggaacggcatgccatattggtcaggagcaagcaaacactaggaggaaaactaaaagtactggcattgtgatttggaaggtggtaattaaaggccccaaccttaataacgactggaaccaaaatagacttttattttattttttttaactaacgcatcttcattgtcttcgagcctgacatttttaagattcactcttctttgtgtttttaacaggatttgacaatgacatttcctccagcccaggaaatcaaatgtccattaacttgcataattaatattttaaaatgaaccttgaagatttttttgaatcacagtactaattaagactttctctttctgccccctctctcttttccacacagactcctgcacagagaaaatgggtcacggaataagacagagaaacatgggtcatcattgtggactagctgtgagatcttgggcaaactacttcatctctgtaaatctcagctccttttccaggtattatacaacagagttaggaatggtaactacctcataggtttgtgataaggattaagcaaggtggtacatgtacagtgctttgcataatgcatgtacagaataaaacaataataaatagtcattttttaaaatgttgacctgtagccgctttaggggagaagaatatcatgaagtgtcattggtcaataaattcatcagtgaaaaaaatatttcagtgtcttctgaatatatactaataagatggaaggaggggaactgcagatttcatttctgtatgttatgtatacatttcatgttatgtttacatttatacacatgtctaaaatgtgtacttgctaatacagatttgggaagtcaagaagtttaggtcaatggtcttactagcacggtcaaaactgtgataaatgtcctgtccattaaacttgctggtggctggcagtcttgactgtatacctgctgctgaaactattgtttttgatgtatctaagtatacttgcccctctactcctcatatcccttggctctttagagtctgacagaatgctttagttatattccatcttgttatggtggtaagaacacagaactggatgggataaagccaaaagacctacaatgttacacccttaaatttggctacttgtaggttataaatagtcaatgttatcttttattaaaggattcactttagaaataataattccaggagagaataggacaccacatgctatcccagtgaacaacctggtacaggtataagatgaagtaagtgatcctctggggagcatttgaggaaactccctggtggtcttgaatttaggccttgtttggagataccagaaagaccctgagatgctatttaatttggagaagcaattttaaaaataaagaatagaaagaaagataaagttttagagacagggaagtccaagaatttttttttaagtattttcacgaacatcctaagacgcaggaccaaattgaggaattatttcataggataacctatcatcaggcagaaagtaaccaggcttctgaggcagtgaagtgttgctacaagactgcagatgaagaaacacagacagaagctttccagggtgcccagaatgacatatccttgacaatggccaaacatgtcagcgcaaaacctcaaagaatctggccaggatggaaggagactagcagtgggcacataggatttgactggttgattggtacctcacagcataacgtacaggtaccttgctacagttccttaagtcacagaacatgagcaaacctgaagtttctaggaaacattcaacaaacacatatatgttttcgtggcttccatttataagacatttctgtaaccctacatggtgaaacaaacaaaaaacacccaaatgaacagaagatgccaaaaaaaaatacatgcatttggtgactgagggtgctactatcatgacctgaatattactcaaggttaagcctaaaaatcagcaacttcaacagaaaaggtggctcttcccatagagggcatggagtcactgctttgagttcaaatcctgactttataacttcttagctgtgcaccttagacaaggtactaaacctctccttagtctccacatctgtacagtggggtatgtatccctacatcatttgaggactgaataaacaataatgcatatggttgcactttgtagactgaaagagagctacatctctgtagtatagcaatttacccatctcaaagagctgggctctccgcttaagcaagaagcaaatacctgaggtgtcacatgcatgccttcctgttgagggctctctctggggggcgctgcgcctataaatgatgtggggtttgttttgttcctcttcatcttcttgttcatccatagactgtagtggttcaataaaataatccccatcatgagaccggaatgtgcccagctgcaaatgaagagagatgggaggttgatttaacgtaactcagtcattgggaggaaaaaaaccaaaagaacattttcaagtagagatggtgtcattttacccaatctctttttcaggagggttgtttcaactgaaaatgctgcaacatatgcggagaagtggtttatttccactctctgtcatatcagtatattttctaaaaattatttattatttactattcttattattttagagatagggtcttgctctctcacccagccttgaactcctgggctcaagcaaaccccccacctcagcctcctgagtagctgggattataggtgcatgccatcatgcccagctaagttttttactttttgtagagatgggggtctcaatatgttgcccaggctcaatatgttgcctggctcagcctcccaaagtgtcatatcagtaacttattcttgatttgacttcagttgattgtacctgctatccaaatctgtctctaagaaatacttccttagagctcaagttccaatcattcctgcaggctgtcgaaagagtcttggaaacttagagagcctagaaacttagggacaagtatgcactccagcaggaaaagctggcctattgaagtcttcccattgattcaaattcaagaagcatatgttggccacaatgcattcaaggtggtaccacctgtaacgctggcacatgatcctctcaccaaccctttcctttgcaaaataggggagtgatgtcctgcaaggctttgaagccagattgccctaggttccaatttcagcaccagcacctacccattcaccttgggcaagttccttaaccactctgtttaagcttccttgttcgtcagctggggataaagatacttaatgtaaagagttactgtgcagattaaataagataatgataattaagtgcttagcaaaatgcctgacaccttgcaaaggcttagaactcgtgaacggtttttggtgttgccagtgttagcctctaaccattaggataaaatttgctcttactaatcattctaagcaccttgcaagtcatttttgctccttttcaccccacatacccaagtttttacaaatgataaatgatacctcaagattgaaccacccaaactaaaaattacaagaacactgaaaaattccccatgccaagttgctgagtggtgtttaagaggagaaatcaagctccactcttctcctccgctttctcatttcccgtgctggaaaaaaaatctgatgccttgcatccttccattgacacaggagaaatgactccctgaacatcagcagctgcatccgcatcagcatcatccaggagcttattagaaattcaaataattgtgctccaccccaaatctgatctattgaatcaaaatctctaggggtagggcccaagaattgaaatgttaatgagctcccagggtattcttacgcatgataaagtatgagcagcactaggctaagacgttggctccccaaaacagctagcttcaaaattgcctgggaaggttttttgtttttgtttttaaattagatttagggcattaccccctactcacagattcagaatttctagggatggatctagaatgtttttgttttttgttttaaaagctctccacatgattcatgagcccctggtttaagaaaagggcagctcaggtgtggtcagactaagagacagagtagctagttgccagagaagcagtgatttaataaatttattctctgcctgtgttcaatacacaactctggtgttctctgagcacaaatcagagagcatatcacaacatgtgaagcctatcagagacatgagtcctgggaaagagccagggagctcagctggtgacgatttgccacctttgattggtaaatggggaaaccaagacacagaaggaggaagtgattgggcccaaattccccttcaatggtacagaagcagctgcacagcattgagtctaacctgactttagtctcgtgcctttttataaaagaaccctgaggttctcttcaggagaacaggatcagtctctggtctatggttaagcacatggatcagaaagacccggttgaaatcccagcgctgccacttacgagctgtgagatcttgagcaagtctccagctctcaaagtctcagatttttttttgtcagtaaaatgtgttgttctgaggattgggttcttggaggatttggatgagataatacatatgtaaactacttacagtagtgccaggcagacattaatagtaagagctcaataaatcatatcaatgtgatgccaaaattaattgtactgttgattcacaaaggtgggcctaagagttatcttttcttggttaaggtgactatttattcaaacatatatgctaagtatatacaacatacaaagctccaatataggagaaaaatgagttgatgctgaccctgttgccaaggagaaaaggatagaacatgtgtaccaagaaccttgatacaagggagaacgtactaagcatcataagagagactctcagaagtgtctatgaagggggagggggagagatgacatcaacatggggaactatgaaaaggtcttctgggaaagaagagatataaattatatacacctccaaagaagggtaggatttgagcatgtgaagatgagtgagaagaccaagtaaattccaaggcacaaaggcaatgaagactaggattgagggtggggtgcagagaaagcagtgtaaaacccatggcctgaaatgcaggatttgtggaggaaagattgggagctgagactggacatgtggatgtgagtgagtgcactgtaaatagtcttaaatgccaaatggagttagcgatcgaggagaaagactggagaagaagcccagtgtaatatttcttagacatcagtcctaaggagagagggggagaaaagtgaagcgggatagatttagggtagagatgttcaggagaggcgggcgacccatctcagatgaaattcagaaaaactgacaactgactaggggtggcaggatggcacagcccactccaaaatctggtagactctggtagactcttcaagatttcctggaagactcctaggcggagaactagcaacatcttgatgccactgctgcagaagtggtaaggggaagtcttgggaggagataacttccagaaggaagacaaaggggcaggggttttggagctagattaatggctgaagatacgaagaaccagaacgcatatctttaagatgtatgagggcccttttccccaaaagaggcagactgcgaattaaacgcaatataaatgaggttatcacagtccaggtagtcgtttctgaagccctagtcctcagttcccaaagaaaccacgtgcgcactaccacctaaaactgccaatgaaaatgaaggtcctgcgcagtaaaatatttatacaactgctggggccactaggcttcagcgggtgtggaggcggggagagaggaggagtaaaggctgtttacaaacttgacgtacacacgcagtcctatccctacggtcctggaattgggggttactatcttggaatctaggggcactccaggctctgggctcagacggctggcttctgcctacccgagccttaacctttcaaggaccagaaggattccagagctcttgccctaggtcctggggcagcgatgactcactgcagcaccccctcccacttcgccaagctgccgtctccgcccacccccaaacaatctcgacagcgcatttcgggagccacggctccgggcgctttgctgggggctaaaggggtttatccctttccttgaatcccagcaggctagaactaccccctcccagtcttcaggcttgccacgctctccacccgatccttccattgaaaggcagagaaggaaggatgtgcttgggaactttaagacccacgaacgacagcgcactgatggagcagcccagtgtctgggggtgagtatccaaggccccgcttagaaaagggagggaggggctgtgggtgcttcgggaagaataaaggcatcaccgggcacagtgcctacgaccccattgcgcttacagcgccgtgcgctgggagagactgacccgggaaagtttctgcgtcacacgcgcgtggcagaaacgcacgtcgcttgggaaagtcaaggaccacccttgctcgggccagaaccgtaccgcagcgactcctcaaatgtcgtggagaagtggggggcagatgccttgtaagatccactggagggcacatgcgggggtcgacagagagtcggggaaccaacgtggattccctgctaaatgctatttggcagcgcaagaaggcggcctccccgccctgcctcagtccctagggaaacgtgcgccgcaggctccctctctccactccctggaacccgtgagtagtagaaaccccagaggaaccgaaatcacgtccggacagcctctccaggctgtctcccactatcccgtttctcccggccaccccgccagtagggtgcagagttggactgcgctgcacccccactctcggttccaccccaattcaaagcgtccggggtaggctccgccttctcccccgcccccagagccctcggcccacccttccgttcctgggacgggacctgctccctgtcaatccagttcagcctcagggttcctggcgcgtgaataaaggccctgagagaaagcggggactctagattacgcaccgccctccacaacacacactgaaggaactcccagtgccttgggcaggggatcctcagccccacatccccgatgcaaggcgcaccaataaggagtctggtccgccctgcgctcagcggctccgctcccgggtggccaagtttgctgcagggaaccgcaactccagtaactttctccgagtttggaaactgacttccaggccgcctcgcagcgttgggcaacgcgccgctgaaccgagtccaaactccagaaagctctgaaacatccagaagcccctgggggcgggtgtgtgcgctccacgccagtgtactcgcacgcacagagctagctacccaaaccatacgagtttctagctgatatttaacgccggagaggagcggagcctcgccacagtgagggtctctaggcttagaggacaattaagtcttctagaagcgggcgaggaggcggaaggggagaggaggtggcgcgcgcccacttaccattcctgagcagaggctgatgacggccgtgtgctcggagttggtattgacatagcctttgtagaaacagtgcttgagttccgcttcctcttcggaataaaacttggtctgattcaccccgggcgtcccgaggagggtgacagtgaacagtggagcgataaatccggcattggcggtgagattaaatagaaactgctggccgaaggcagagaggcggtaatgcgcctgggaggaggtagaggaggaagaggaggaggcgaaggcaggccaggggtcagtggcagagttaatgctccgtcgcgttcttttgaagtggacgttcgtgggaaagggttctccgagagcgttcactcggatgggagacacgatttcgtattcgctcagggtctctaataatttcactgcggagagaagcagaggtatatgaaccaataattcatttttccttaagctttaatttaaaacgaaggtggggactttgttctgaccttattttccagcccattcgagtcaatcccttcacccttaatcagtggacaaatatttgctgagcacctactatgtgccagtaacaggacctgtgctaggtgctgaggatacactattccgagccagacaattaacaagtcaaaatatatatgatttcagatattgataaataacctgaataaaataaaacatgacgctatctggtgcccccaattactaagttactttagtttgcggcgtgggagtggggatggggatatatctggcaacagcaaggtaggggggggttgcctaaattcgtttccatagtgtccctccctagcaattggttggggatgacccaaagaagggagaggctgcaaagcgggagataattctttctaggaaaaggagagaagcctccgctgcggggtgcccctgcccaggagcgaggaccgggaggcggcgtcggggccggcggggtcccgggggccggagcctggttaccttgcctcgggtgcagcctgtccttgcgcacggccgccgcggcgtctgggctccccatctcggccaggtcccgcaccaggagcgttagcagtgtggcccaggatacaaactgcatggtgcttcccacccctccctccgctgccccca

SEQ ID NO: 1102 - DNA, 331234 bp, Homo sapiens
tttaggtaattgagagtacattttttaaacacaatctatgcacaatacagtgattaggcatattaggggtaaagagctttacaaaacattgctgaaacataattgcgagtctgaatcaaatcaaaaagaccacagaaatattcagtattgtatcttagtttctgttaagtactttcaaaatgtatttaatactaaaagtaattagtagaagagaatttgaattcttgatttttgttctgaaaatttttactctcgatatattaaacaaacatggaaaacttctgtattaaagtcttccacatgtaaaccatttgtcattcattcatatatttttctactttacttctttaccaaaaatcgtgtgatgtctgatccatgctttgatgctagagattgtcttctcacctggcttctttccttagcttgtctggcagttctctaaaagttaaaaaatatgcatgtgtacacgttaggaaaaaagcaccggctacaaaagctcaaaaactctttatattgttagtttggaaaatctacagtcactacacccattttccagtggttggctatggaagagttaccaaaccacaaggcagagtatctcagcagctctgagatcctgaggtcctaggttcataggaccaacatagcaggagaaaacatacaacttgggggatgtcttgctacccagcaacagcatgaattcctcatttggagactaggaaggccctgattctcccatccaagtgggaggttttttttttttttttttttgagatggagttttgttcttttgccgaggctgaagtgaagtgatgtgatctcggctcactgcaacctccgccccacaggttcaagcaattctccagcctcagcctccagagtagctggaattataggcacctgccaccacacccagctaatttttgtatttttagtggagacggggttttgccatgttggccaggctggtctcgaactcctgacctcaagtgatccatccacctcagcctccccaagtgggagttcttaaggcaacttgggattacccagcgaagaaaatctacccacttcctattctctgatcccagaggccatttccaactcaacagatgagctggtgcagaaaataaaatgacatagaccagaactggattcttctgctaatcccacaaataacatttttcatgagaatctaaaaaaataattacagaaagggctgcattttctttggctatttcttaattctcttataggtcttgaatttgctaataacttgcacatctgagaaatcagatgacttttttttcccaattgaagtccatgtgaggtgttccaggcggaaacagtaaggacagaagagaagcttacggtggagggcggtggctcacacctgtaatcccaacgctttgaaaggccaaggcaggtagatcacctgaggtcaggagtttgagagcagcctggacaacatggtgaaaccccgtctctactaaaaatacaaaaatcagccaggtgtggtggcgggtgcctgtaatcctagctactcaggaggctgaggtaggagaatcagcttgaacccgggaggcagaggttgcagtgagccgagatcatgctgagatcacaccatcacactccagcctgggtgacagagcaagactctgtctcaaaaaaaaaaaaaaaaagtagtaaagagttcatactttataaacattggcaaaggatctgaaatagtactcaaaagtttaaatataactgattagcatcttttaaaaacatcgatgtctttagcaaacaaaacaattgcaggccattctccctgcaccacattggcacccactgaccatacccagtggcagttaaatgggcttctggggccataaatgagtaaaattctttggaaaacagtttggtgataaattcctacattgtcaaaaatatccaaatacttgtgactccgtgatttttacacatgagaatctaccttaaggaatgacctcaaaatgtagaaaacaggtttgtttacaaaaaatgtgcttggtggcatgatatataaaagcaaaaaaatttagataaatattaatcagtatgggaatggttaagtaaactacagtagagatctgctcaatagaatactgtattatgcagtcattttagatgatataagttatgaatggttagagtacatgagaaatgcttagatcttgctgtaagtgaaaaaaagttgaatacaaagttgcatattgaatatttctatgatgatctcagcaggtaaatcccactaccttttactggactgcctgtaaaaaattcatcctggtagataaacaatagtatgtgttttttcctctcattctaagcaacaggtaactaactacccaaagatggggcagagttaattggtttcatactttggccagcaatgaaacctttgcatgttgaactgagttggtcctagagataacttatcaatgttttcagatatttcaggatatccttagttatatgcaaacatgtatcactgccccaattcaccaaacttccagtttgaggatccgggtctcatcaagacaatatgtaaactgtattcatttctttcttggtagtggtgcaaatgtcttggtcctagaatgaatgaaaagggaagcagcttctcttgcatctgtgacacgggccttgagaggaaaggcaagtgttgggtgatgaaaggagtaaaatgtgcctcgaatctcagaccagagataaattcatccacataatcttccacaactgtgtgcacaattttccatttgacttctcaggatgcagtcaaagctatatgagagcttcactgacctctttgtgacagactgtgcagagagtctgcaggttgtccagggaacactgtcctcctcccccatacactggcttgatgtgatccacctgccagaaatgtccttcccctgggtttcttatcatttcatttagctgcaataagaatacaagatcagcaattttcaacatatactgcaagaagtgtttgttggttttgcattgtgcaatcatgtatgtttatacaggaaaatcatggggaaaaatacatcaggagagctttttatagcttttattgtgagtagaaaaaaccctctgttagaagtttgaaagcaataagatgtgtttctgaaaggtttttttctcccttaacctaactcattttgaaaaaattacaagaaaatataaaataccaagactcctgacagattgggaaaaactggtttttctacacctgtaagttagtttatatattcactaaaccaaatctaagaaaagaataagaatagattagaaatttaaaacttctcagccaggcacagtggctcatgcctgtaatcccagcactttgggaggccagggcaggcggatcactaggtcaggagatcgagacaatcctggctaacacggtgaaaccccgtctctactaaaaatacaaaaaattagccaggcacggtggcaggtgtctgtagtcccagctactgcggaggctgaggcaggagaatggcgtgaacccgggaggtggagcttgcagtgagcagagattgcaccactgcactccagcctgggtgacagactcggtctcaaaaaaaaaaaaaaaaaaaaagaaatttaaaacttctcaatactactgagtcaaacaatctttaattgttgacctaaatgcttttgtcactatacaatggcagtttaatgtcaatagctattacctagaacttttatactattcaccagagaactttccaagttatgtgaactggaatgaaatttctagaacaaatatctgtaacttgcatatttggaataattaaagatgaccatttaaagtagcctttatttaggccagtccatatatacacattttatatttaatcaatgataacctacattaaaatgggatgtattttatcattttacctgaggtagtaaaaccaactcacaccacggcaatgcagttgtctaaatatcacaaagatgagtatggcacttgcttttatttccttcaacttcacggctgctggccatgggaacccatgattatgtataaagcctgtttaagcaagcctgtcaggcacaatgacctgatcaatagtgctggcccatgaggagtcacaagaggcaacaagttggagcagtaaactttgtccagctgacctttgttactgcctgccttaccttctcttctgtgctgaacttcccaacttctgttagaagaaatgtattgatttttgtttttgaggttggcattgttagaagctactacaaatggcggtcttgtgcatcaagcaaatggcatagtcttagggaaaaaaaaatccattttggttttgcctttttaaaccaattccttctctctgagcagcccccactctgacagactcaataattcagaagatgcttctttagtttttccaagcaattgtaaggcaaatcacttgaggccactcttcaatatcctaaatttgcccacctcttgaaggaatcacttgatgtggtagtgcatgcctgtaatcccagatgtttgggaggctgaggcaggaggatcacttggcccaggagccaggagttcaagatcatcctgggaaacacagtgagatcccagacccaatctcaaaaaaaaaaaatatatatatatacatatatatatataaaatataaaaatatatacaataatatatattatatgttttattatatattattataaatatatatttatattatatatttatatatatattatatatacttatatatatacattatatatacatataaaatcactctctagtcctacccaattcgagcctattgtgttccttattctcagagcacttttgttttagatgtctattatattacttctgcattcctggacaggttgctttcaatgaccttgagtcattttgttgcatgtcttctggaagccatcatgctgaaacagcagtaactggagtctgactgacatccctgggatgtgtacaatatgtccctcgccaatgagaccaaaagatctttcaggaactctggatatcattagagaaatagtgtatttccctatctctcagagacatgctaattcatctttgcagaaatgccgattaattcattctttcataattcagcaacactgtcctaggtaaataaaaatatataatttgtcaaactggcaggaattcatccaatattttagtgggcacacagtggctgaggggtgattctttttaaattaagcacattacaaaattacattttatttagagatacggtctcgctctgttgcccaggctggagtgcagtggcaccatcacagctcactgcagccttgaccttctggactcaagcaatcctcctatctcagccaaccaagtagctgggactacaggtgcatgctaccacacctggctaatttttcaggttttttttcttttgtagaaatggggttccactagctgggactacaggtgcatgctaccatacccggctaattgttctggtttttttcttttgtagaaatggggttccactatattgctcaggctggtaactcttggctcaagcaatcctcccgccttggcctctccaagtactgggattacaggtatgagccaacgcctggcctagtttgaaatttagaattgttcagatagcaagattagaaatccagttgaattttggaaatgaaagtgaatattgatgatagtgttctataaataataatttgtcataatttgttgtattaaaattacatttttcaatgcaatgaacacatatatgtgtgtgagtgtatatacacatacatagcctctgattgtgatggactacatttctgggttatctgtttgcctcttgtctttcaatattaacatggaaaggggaatcgccagaccataggtgcctcttgatatactgcaccacctgttaagatcttttcccaaaataactgaatgagaatgaaactaagcctctagatcttacaattcttactgagaaaattgggggaacagaagaacatgtcaaacaataccttgcagatacaggaagacaaatccagaatggcaaatgatccagtatattcaaccattgatagtatgatagtataaaaaaggaatggggtgctataatagattaaatgaagcataagaggcattataatcaaatatactatgtgggtgacattttgattctaatttgaacaaagtaactataaaatacttttttttttttttggagacagagtcttgctctgttgcccaagctggagtgcagtggcatgatcttggctcactgcaacctctgcttctcaggttcaagcgattcttctgcctcagctcccgagtagttgggattacaggtgcttgccaccacgcctggctaattttttatacttttagtagagatggggtttctccatattggccaggctggtctcgaactcctgacctcaggtgatacacctgccttggcctcccaaagtgttgggattacaggtgtgagccactgagcccagcaaaaggcatttttgagacaacctgggaaaccaaacatagacttagtataattaaggaattgtaattgtgttgggtgtgataactcatactgggattatatttaaaagaaagagaggaaaggaaatgaggacaagcaaagagggaaggaggaaaggagaaaaggaaggaagggaggaaggaagggagagagagagaaaggggaagagggaggggggaacaggggagggagaggaaaagaaggatagaaggaaggaaggaggtctttacctgtgagagatacagaatgaaaatattcaagagtgaaaagaaacgtttggaattttctttaaaataatctaggagatggccgggcatgatggctcatgcctgtaatcccagcactttgggaggctgaggcgggtggatcacctgaggtcaggggttcaaaaccagcctggccaatatggtgaaatcccgtctctactgaaaatacaaaaattagccaggtgtggtggcacatgcctgtaattccagctacccaggaggctgaggcatgagtatcgcttgaacccaggtggcagaggttgcagtgagttgagattgcgccactgcactccagcctgggtgacaagggcgaaactctgtctccaaaataaataaataaataaataaataataaataaataaataaataaataaaatattctaggagaaacaaacaagtgagtcaatgacagatgaaaatgaatgccaaaatgctgtaaactgttaaagctggctgatggacatatgggtccattattttctttccttttatatatctgaatattcccatgttaaaatgtacaaaatagagagtcaatattcattactcagtacaatgctgccttctatctatcacatgattataacttacctgttctaatgggagctttgaagtccaggtagcatacagaagattcttcctctgacttttaggggcatctctcagacgtaaaaagagttcttgtgcgttcacattacagagctgacacacaccatgttcagtttcaaatactttggctctcaggtaactgttattagatcgaatccaaaactcttcctgacatttcagagagcaaaaccgtgaatcccaagagttcgctttacatgcttgcttagtctggcaagtgggttgctgacagcgaaggcaaagtggatttccttcattatccacagcttgcaaatagcctttggatgtagagggcttcacagtgagatctgcctggactgtgtatggatttagaaatgggacacaggctccatcttcaagaagttttctacaattgataaaaacactgaataggtaactaatgaatgattaggctaaatagtaattgcttcatataaaggttatcaaagtttcaatacggataaatagtaaacacagatcacagtgtagaaataaaatagttacagtcagcactctatattccatgccaagtaaagaagaatggtgtgttacaaaaattaattgaatataaatatgttgcctctcttgggaattaacacaaggggatgcccttgtgttaaacgatctggaaacatgtgaaacatctggagaagctgttagaaaatgcttcttcaggctgggaaaggacaggctaatgtaaaaccccaaccaaagcttagtggctaccctgctccttaaatatatgtggtcacacacctcattagctcagagaggtaattacaaactctctcctccagcctctgctagctcacaggaaatagagtcacagccataaagtgacagagtgaaatagctgacagtgctgataggaattagaacagaagacttgctcttataggtaaacgcagagtggatgaaattaaacatgataggatacaaaacatgataggatatgtgctcaatttgttagaataaaagaaaaggtacactactcaattttgttagaaagtcctacttgggaagtaacaacagctgctttgtctgttttccatggttgtttgttagaagagttaaaagaaagacttctaattatggagctcaagattcggggacagagcccagatttaacctcaggtctcctggcctctacccgcaagccctggggcaggttacttagtccacctggtctcagtgtccttcttcatctctaatgtttaaaatgaggacaccaggtacctcaacaggttgctaggacaactgaagagctactatcttgtgaaagttctttgtaacctctaaagtggtcatgcaaaggtgagatattattatgaaaatcaatacataaatgtaaaggagtggaattagtactactatatactagtagtagaaaaaccttactttgtgaaaggatcccgtggcctggactcctttgtgatcagacggacatggcccccaacattcttcactttgtccattgaggctacggcaacatcttctttggttatgtatctaaaacaatgatatgttaaatagattccctctatctcatataaaaatgtctctattgcatgtttacattgttccttgcaaaagcaatagaagaaaaagcaagcacaattctattaactgtgctgaaactcaagttagaaaatggaatttttaccctttatcttggtgtccattatgtgagaaatacatctctttgttccaaattagttttctcaaatttctttttctaagaaattcaagagtcattcaatatcctttggagcaattttcatttaggggaaaaaggagtcggtgtgagaataagaaatgatcaaatacacgcacaactgacagccttaaggaaactgcttggcaagctgtgcagaaaatctctaactgtattttacctccctcttggccttcccttcaaggcttctccaaatcaccttagtcagttataatagtgtatcagtgtttgggtaaactgagtttctttttagttaaccaggttcaatcacatcttctgtaatctcaaggttgttccccttattatcagcccatacagggtttatggattcttccacagaaataaagccactcttgatatgggattcagaaccttattacccaacactaacaataccacacaatgttcagggactagaagtaaagagaagttattcccattaaaggtgatgggggaatttaagttggtaaaatgcaattacctgattaattccttcttattaattggcctagtttctctggtggtttacacctattgtagatttttttggaaattagtttaaacatgaatttcttaatattattgagtgcttcttaattaggcagcttgacaataaaattaaagttcaatcacaatggaattgtgcaatcgtaggtaaaattttagaaatttgctttatgttattaggatagatttaataataaacaggtttccttttttaataaactattttattaatttttgattaggtgatataagcacatggttctaaattcaaaaggcaaacaagcatgtttatggtgatgagaaattttctctctcactcccatcttcctttttcccctccccaaaagttacctctgttggcagttttgtttttattttattttgactcaaaatgatcttgagtcattttattgcatgtcttctggaagccatcacactgagacagcagtaactggagtctgactgacatccctgggatgtgtacaatacgtccctcaccaattagaccaaaagatcttttaggaaccctggatatcattagagaaatagtgtatttccctatctctcagagacatgctaattcatctttgcagaaatgctgattaattcattttattttattttattttattttattttttgagacagggtctcactctgttgcccaggctggagtgcaatgacactatctcagctcattgcaacctccgccttctggttcaagctattctcatgcctcagcctcccgtagctgggattacgagcacgcaccaccatgcttggccaattattgtatttttagtagagatgggaatttgccatgttggccaggctggtctcgaactggcctcaattgatccgcctgtctcagcctccccaagtgctggaattacaggtgtgagccaccgtgtctggctcattttagaaatagtttatttttggcctggcatggtggctcatatctgtaatcccagcactttgggaggccaagatgggtgggtctcctgaggtcaggagttcgagaccagcctggccaacatattagtctgctaatagtgataggtatctcatcatagattttaaaattcgcattcctattaagagtaagggggaatatcttttcacacattcacatggtgaaaccctgtctctactaaaagtacaaaaattatctgggcatagtggtgtgtgtctgtaatctcagctactcaggaggctgaggcaggagaaccgcttgaaccaggaagatggagggtgcagtgaactgagattgcgccactgcactccagcctgggtgacagagagagactctgtctcaaaaaaaagaaagaaagaaaaataaaataagaaatagcttatttttttctgagtataggtgtatgccttttatttacttacttttgcatttccattgacatatcattcacagagcataaaattcaccaatttaaagtttacaattaagtgcattaacagtatattcacaaggctgtacaaccatcatcactaattccagaatattttcatcactccaaaaagaaacctgaggctgggtgcggtggctcatgcatgtaatcccggcactttgagaggccaaggcgggtggatcatttgaggtcagaagttcgagaccagactggccaacatggtgaaaccctgtctctactaaaaatataaaaattagctgggcgtggtggtgcgcacctgcagtcccagctacctgggaggcaggggcaggagaatcacttgaatccgggaggcagaggttgcagtgagctgagatcccgccactgcactgcaacctgagcaacagattgagaccctgtctcaaacaaaaacaaaacaaaaagaaacccgtacccactagcactcatttttcattataccttttatttttagaaataaataatagcatagcatatacactaatcttcaccttgctctttttaccaaaacatgcttctcagagatctttccttattatcatagtttccctattctttttaatggctccatgttattccattatatggataaaccatatatttaaccagtctctcataaatggacatttaggttgttttcattctttgctatcacaaacaatgctgtaatagatatcgttatatatgatgttttctacacattatgtatctatagaataaatccccagaagtagaattccttggtcaaaggtcttaggtgttttaaatgtgggtagattttgacaaatttctttcctctaaggttataccagtgtatgtatccaccagcaatgaataagagtatctgtttcttctctttcactagcacaatgtcatttttaagagtctctgctaatagtgataggcatctcatcatagattttaaaatttgcattcctattaagagtaagggggaatatcttttcacatgtttgcactctacttgcatgtctttcttagagcaaaaaggaaattaagccatcgtgctccagtctgggcagtagtcgtagttaaagcacagtaaattgttttagagttcttttacttgcccttttagttcccaaatttcctccttctctggccccacctccaacaatttcttcaaccattttattcccttgaaaaatgcactttgggaaagtatttctgtgaattctaaatgaactcaaaagcttcctagctttgaggggcaatgggatattaagccttgcctgaggtattattcaatgtttaaaagcttaaaaacctaattcagtaactaaaagatgctgagaaatctagtcagagatttagaaactaaaaataaccttttgctttcctacaagaggtttaagaataaatttttggaaaccacaagaaacagacgaacaaattccaaaaaacggagctgacaacttttcaaacgtagttgcaagttgccgatacttaattttctactgaggtttgctaggaagttcaccaactcccaaaaggattatggtaaatcccaattttagtaaatagagaagggagaatgttgtctactaaacaaattcctggatagggacgggagtggaagatggcaatttttgcaagaaaagtgtacgttgcaaagtggcccacatcaatgaacacaatcttgggctctggatttctgacctgcttttgagctcagctgtaaccagagattaaacaattggcatcctaaacatgacagggctccaagtgaattaggcctgcctctgataaatgggactcagtaaccaaaacagtggctggtaatcttggctaccattcaaatgtaaaagtgagacattcaaaagctgactgcaagctctgagcttggatggggcctgcaaactgttggacatcactggcggataatctggttggagacctttatcaatgtttctgggggagtgcccaaagtcagttaactataggtcttttttcagaaccattcagtacttttaagagagaaatcctctaacgtcctgcttaggaagtaaaatgtcgctgctgtcaatctgaaagctgtgcaaaaaagggggtccgaggagtttcagttttcaatataatacctcactctttatctctactgagcctgatgtttctaagtctggagactctctgattcagtttctctagaaagtaaattgataggacagtgtctaactgatccttatacagactgccagtcaatgctgttgttcaacagcatatttcacatttgctttcagagatacatggttattccaaattactgagacttaacttgggttctgcagcaagaatcagaatgcttcccgatagtatctccctgctgcaggtacagaggtttcatttcatgatgctgctaagttggtttccctggaggcctctctctctctgcctctctataatcagtcaccaagtctctagatatacctccttaagagctctcttcattctctttcctgattcccattgtaataacttaatacagatcctcatcgtttttctccaggtatactagaatagtcttttaacttgtgtagtaggcagaattttaagataccctctaggattcctgtccctccgttatttaatcaatcactaatttagataatgctataaaaggactttacagatataattagattactaatcagctcactttaagatagggagattactgagtgggcccaatgtaatcacttgagcccttaaaagcagaagacgaaggcagagagattccaaggagaaagatgtagtggtccatgtgctaggaccacagagaggcctctaggagctgatggtccagccgacagccagcaaaaaacaggaacctcagtcctacaactgcaaggaactgagttctgccaacaatgttagtgagcttggaggtgaattcctttccaagcttatcaactagagcccagccagccaacactttgatttctgccttgtaaaatccagagcattactagaaaactagtaatagccaacttggacttcttacttatagaactgtgagataataaatgtgtgttgttttaagctgctaaatttgtggtaatttgttatggcagcgatagaaaaatgtaacttatctccccactttgagtcttgccctttttgatctaatctcccaactgctgctagagctagctcttaaaaatacaaatctgattaatctgctgcttgttaacacaagttatatccttaatatattatgtatatataattttataaataatattgtgtctgactttggttttatgaattgacttttgcttttaaatctgatcagtcacctttctcagttggtactttaagtggtcatccatgtccgatggagaagaaatagtaggacatgtccagaaatagctagaaattcagttatgaaaagaattatgatcatgtgagaaagagaaggtcaacaaagactggttacaaaaatgagaaagattgagaggactggaagttttgggaaaaataaaataggcattgtgctttttgatatatgtgtgcgtgtgtgcacttatgtgtaagtatgtgtatatatgtatataaatatgtaacacatatattttaaatgtatttttatagaaaatgacacacgcccatgggaaaaaaatcaactgttacagaagagttcaggctaagagtcccaaactggcaacttatggataaattcaattagtcaaaggactttactgtactcatacagcattaatttactgtactcatacaacattttacatttatttattcattttgagacagggtcttgcttgatcacccaggctggagtgcagtggcacgatcacagcttatcgcagccttgacctcctgggctcaggtgatcctcctgcctcagcctcccgaatatttgggcctgtgggcgtgagccaccatacctggctatttttttggggttttgtggagatacagtctcgctatgttgaccagtctcgtctcaagctcttgacctcaagtgatctttccaccttggctttccaaagtgctaggattacaggtgtgagccaccatggctagccagtatttttttattttattaatttaatttttgttttgttttattttattttatttctgagacaaggtctcactctgtctcccaggctgaactgcagtggcacaatcatgggtcactgcagcctcgacctccaggggctcaggtgatcctcccacctcagtctccaaagtagctgggactacaggcaccaccatgcctggctaatttatctgttttttgtagagatgaggttttgccatgttgcccaggctggtcttcagctctgggctcaagcagtctgtcctccttggcctcccaaagttctggaattacaggcgtgagccaccatgtaccagtattttatttttaaatctgaatttgaatgacttcagatgggttccaaatctgccagtttgacatagtctcagcccatatctcatccttttttagttttataactgacctcattcattcatttgtgattcttgttttgtttttagtcaaatgagtttgtaatcctggcataaagtgtaaagtccctactacctccagaaatcctcaagttttatgccctagagcaagatttctcaacagtggtaatacagacattttgaaatggataattctgttttggggggtgcaatcctgttcactgtaggattctcagcagcatcctgggcctctacccactagataccccctagtcacatcccttacttgagacaatttaaaatgtctccagacactaccatcctacgggaccaaattgctccaaattgaaaaccactgtccaagagaaacccgtgataagaatttctaaggtatccttctagacaatttctatgtcagtaatagcaagttgtgcaaatagtgaagtttgtgtctccatccctttttttttttttacaatttatatttacccttaacaatttatcacaagtattattccttgttcttacaaacaaataaatgtaccatatgccatatgttgaaacagtggaaaagattttcgctgtatggaactatcataatttatttaatcaaccatgttctcggtcccttgctcccctccaaccccctggatttttttcacctgtgtgcatggaaaaagctagagaaaggaaacctctctgataaactgatgaaatataaggatgaagagagattacaggtgtatggaggcagcaagagctaaagggctttctctgccaatgctgccatttggtttattgctttgccatctgttttgttttgttttgtttcagacagggtcttactctgttgcccaggctggagcacagtggtacaatctcagttcactgcagcctcaacctcccaggctgaagcgatcctccggcctcagcctcccaagtagctagaactataggagtgtgccacctggctaattttttttttttttttttatagaaacagggtctccctgtgtttcccaggctgatcattgaactcctgggctcatgcaatctacccgccttggcctcccaaagtgttgggattacaggcatgagccaccgcgcgcagcctgcaatctctttcaaaagcaaggattgggctacaaaacagctgatcacttttcctgataatccttgcttcatgctaagaaaagagtttacaaagaacagggatttgagatcacacatggggagacttgagtgggataaagatgattgtgatgacaaggaaggaaatcaatgtacagagattagaaaggaacctgtaatgataaggacaaaacagtcacaaatatctgacggtcaacctttccttttatttcatttccaatcatggacatgattatagttatcttccattacttgggtggtgatgcattcaaatagaaccagctcccttgctgcacagcatcatactcacgcacagcagggcaaagcagatggggtccagaggcatgctctgatgttctaagagtaaaatgtattcctgctgctaataagtgtcccaggcttggcaggtcataggttgcaccatcctgtgactctggtctttttgttgattgatgggactcatggagagtaagatctggacaacctgatctcttttagcagattttgtcaaattcactagacatataattatcttgttatgaaacaatatggctgtgattttatgcataattttctcataactcatcaggatttcattagtggttccaaaagatgcctcagacccccctgtagaaagaaccatgaaaagtaatataatacaaaatttaaaaaaagacaactcataccttttggtgcaattttgtttggtttgttgctttgtgatctcttccaaagcaagaattgggctacagaatagctgtccacttttcctgattatcctttgcttcatggcagttagactactccattctcgaacaaatctcaaaatctggcagaaaatgagataataagagttaacagctcacaggcagatatcttcctttgaatgtgagcctatttacaacatcagaaaactgctattttgttatgtcccccaaataggcttttgagttccataacctaaggctttcttcaatttgatgcagttttcatatctttattgtaaactacctacagcagttctcaagagatatctcttttttttctttttgatagggtcttgctctgttgtccaggctggagtgcagtggcatgatcacggcttactgcagccttgacctcctgggctccagcagtcctcctgctgccttagtctcctgagtagctgggactacaggcacatgccaccatacctggctagtttttctattttctgtagtgacagggtctcactatgttgcccaggctcgtcttaaactcctgggccaaagtgatcctcctgcctcagcccccaaagtgttggcattacaggtgtgagccatctcacccagccaagagatctttttcaagccaaagattctctaaaggcatgtttcaggacatgcagtgtatgcccttaacacacatagatcaacagtgataatatgctcattgagaccaaaaaaggtctggaagtacataccctagctggggtcaaggcaaaactgggtgacagaatgatagtgcaacatctgagaattgcttcgtaaatgatgcctacgttttcacaggaaaaaaaacatcaataaatctgggacatttttagtagggttaccagtcaagtatacacaactggctattttctgggactctgagaatcagggttagatgattccaagtaaatagcttactgctcccttttcatttaaaacaggtatagttgacctacgggcaatgcttcatttccactcaaatggtaaaaaaaaaaaaatcaccattttcttgtaaaaatagcacacagcatgctaggttagtccctgcgcatgatgacccttcttggcagtgaaggaaaatcagccacagatcagtgttaagacctccctggcaggaacttggcctgaagctgcatgctagtgcttctgataatgaatcaagaatcacccaataaggtattatctctgctctgggaatttgtcattgttagaacttaaccttaatagaaaaaatgtgattctagcagatacaaatatcacagttgctaatagtgtgaatgagaaattaaataatgtgaggatgattctatccacagaaacagcaactgtaggtgtgatcatttgccaaggaaacagatttcacatatattcttagcactgggtaattaataggcaccacctagaatgatgaaaatgcaaccagtgatttgactctacaacatgccacaaagtgcttttttaaaattaaactaaaaatgatcattaaaattactaaaacaagtttatttaaagtaaataaagccattttatttaaaactattcttaccagtgagcgatattgtttcagctgaaagcttgctggtaaatcttcccaaaggtctaattttatatccagaggaatgaaattacagctcatctgttttccatcctgatgatagattaggaagacactaataatccatttttgtataggcactagtaactattttaaatgaaaataattacattatgacacaatatgcctagtctcctaaaagaaaaactgaggtgacacattctagacaagggtccaccaaaatggctcctctggagaaactgtgagccaagaagaggaggcaggctctctaccgcactggatgcctccattgcccatgcctagcccaaggctattgccttcagcctggaatcctttgtttactgctgtgtcatactcttttctattgactaatcttggaaagatgtatcaaaacaataaaatttgtacactgcaaattaatatagaagaatattacatccttgaagttaacagtagcacaaccattccaaatttgcaaataaacttctttatactcactgacaatacaagtatcacatcaaagaatggtatcaaggaatagtcttaataatcttcaccaaatgatatgcctgtccattgttacaggaacaaggaagtaaagagaaggtagaaagatcaattctagagaaattacttaaaaattggctcccccaaagcaatgtcacagtatcagtcaatgaggactgtctgccaatggtaccacctggagagtaagtggaactgcatttaggtcccatcaatcggtgcacaacatcctgaaatcttttttttccctttttttttgagacaaggtatcactctgtcacccaggctggggtgcggcagcatgatctcagctcactgcagcctcaacgtcctgggcccaggtgatcctcccatctcagcctcccaagtagctggaattacaggcacgttccaccacgcctggctaattttttatattttttgtagagacaggttttcaacatgttgcccaggctggtctcaaaatcctgggctcaagtgatcctaccaccttgaactcctgggctcaagtgattctcccgcctccgcctcccaaagtgctaggattataggcatgagccaccacgcccagcccctgaaatcttaagggtagaaagtaaccacatacagcggtgtagtagagctatttcctttataaaggggaagaagaacatctcatacgaaaatctattatatcaacaatagttgaactcatattctctcagccaaaaaaaaaaaaaagttacagctcccacaattgctttggagaaaaacatacaaaaagtaggcactgattaaaaattttgaggccaggcacagtggctcatgcctgtactcccagcactttgggaggccgaggcaggaggaccacgaggtcatgagttcgagacgagcctgaccaacatggtgaaaccccgtctctactaaaaatataaaaattagctgggcatggtggcgtgcacctgtaatcccagctactccggaggctgaggcaggagaatcgcttgaacccgggaggcagagattacagtgagcctagatcccgccactgcactccagcctgggtggcagagagagactccatctcaaaaaaaaaaaaaaaaaaaaattgatatgtaattctaaaccctgatatagacttgggattctagctgaaatgaacagttctaatatgacacaggatgctaaatgtctgttactactcttcctttaaagggatatccttttaggcagtgaactaggaatttattttttttttttttttgagacagagtcacactcttttgcccaggctggagtgcagtggcacgatcttggctcactgcaacctgtacctcccgggttcaagcgattctcctgcctcagcctcccaagtagctgggattactggtgcctgccaccatgcccagataatttttgtatttttagtagagtcggggtttcaccatattggccaggctggtcacgaattcctgacctcaggtgatccgcctgcctcggcctcccagagtgttgggattacaggtgtgagccactgtgcccagccttacttcagctcttttaaggtgaaaaggaaagctttcatctcagctctactctggttgtgaaaagatatgtcaacaactcatctgcttagtgtcttgtgtttggaaaattatttgggtgataacattttatggtaaagggacatgtaagtatttagaacagtcataaaaatatatttgagaccattaacagagatgtcaagaagaagcaggctactaggctggtggcagagcctgaatacgggtcagtgaggtggtcgctgtggtttggtttggcagcaggtgcattataccctctaccaggagcttgcagttctctccgtctccaccccaacggggataaaacattgatcaggtaatccaagaggcagagctttcattgtatagagtaaaaaaagattaaagaatttaagggcttctggatttctgtggtatgctctgcctggtgtctgtcctttggtttctctaccctcttgggaccatttctctgtccctctcatgtgatggtctgagaaagaggcatggcctaaagatcccccaacatggggcatgagggtggctcaggcacttaaacctgcctcaagatgaataaaggagtcattggtgctccctgcagcctggttcaccatgtcagaggctccacttggtagaccaggctccaaacctataagaggagcattgattactgcctggcttggttcttggtgtctctctctcagttattgtccatgctagaggctgcttggggattctggtattcaaaatcctagccatctcctcctaaaagaatattattacatggtacactatctatctatatctatattcggtttagtagaaaacctgtaactgaaagtttggtcatctccaacatattatcttttaaacatcgatataatggaccatgagttttaaaagtttcaaatactatcttatatacttataaagattagaaatttaaaattttaggctgggcgtggtggctcacgtttgtaatcccagcactttgggaggctgaggcaggcagatcacgaagtcaggagttcaagaccaggctagacaacacagtggaaccctgtctctactaaaaatagaaaaattagctaggtgtggtggtgggtgctgcaatcccagctattcgggaggctgaggcaggagaatcacttgaacctgggaggcagaggttgcagtgaaccgagatcgcaccactgcactccagcctgggtgacagagctagactcagtctcaaaaaaaaaaaaaaagaaatttaaaattttagaccaaataaaagtattcataatctatccaggccatagattctcacatggttcctgtgatcctttcagaaagtcataagtgttttcatactaatagtaagatactgtttgccttttccactctcattctttcacaaatgtatggtgactttttccagtggctacatgaaatgctatctcaacaaactgaacgcagagatggatatgggaatcccactgttttccattaagactttagagaaaattgctaaacatttaaaacaatgacattcttctcactaaatatttttttgacttggaaaatataattattttaaataaaaaatgttatttttatatatatataatgggtttgtttctcttaaaatatgcatttactcacttaaaaataattgttggccaggcatagtggctcacgcctataatcctagcactttaggaggctgaggcgggcggactgtttgaacccaggagtttgagaccagtctgggcaacacagcaagaccctctctctccaaaaacaaacaaacaaacaaaaaacggccaggtgggtggctcacacctgtaatccccgcacttcgggaggctgaggtgggtggatcacaaggtcaagaggtcgagacaagcttggccaatatggtgaaacatcatctctactaaaaatacaaaaattagccaggcatggtggtgggcacctgtagtcccagctacctggaggctgaggcaggagaatcgtttgaacccaggaggcagaggttgcagtgagccgagattgcaccactgcactctagcctgggcaacggagcgagactgtcctaaaaaaaacaaaaaatacaaaacagaaatagaaaaatgtaattgttaattattcacatttaagtgaataaatgaaaaaaacatttttttttttttgagacagagtctcattttgtcacccaggctggagtgcagtggcgcgatcttggctcactgcaacctctgcctcccaggttcaagcgattctcctgcctcagcctcctgagtagctacgattaaaggcacttgctaccacacccagctaattttcatatttttagtagaggtggggggtttcaccacgttggccaggctgctctcaaactcctgacctcaggtgatccacccaccttggcctctccaagtgctgggattacaggcatgagccaccacacccagccataaatgagtatttctgagaggctccattttaatttcaaatatagtagacatcaatagatataacccatacaaacaaaagctctttggggttctcaataaattttaggagtgcaaaggggtactgaatctaaaaagtttgggcactactaagctagcctatggcaggaatcagcaatcatctgacaaaaagcttcctaacatttactcaacacaaatgggcaggtctaggcttctgtaaggatgctgctgctcctgctgctgcaagtgatcattgcaggaattaacatttatggagagttcatataggccaggcactgtgctaagtgctttacaggactcagcttgttttatctttataacaaatcctgtctgcattttattttttattattttaacaatttttaatttttaagggtacacagtaggtttatatatttatgggatacatgagatattttgatactggcatacaatgtgtaataatcacatcagggtaaatggggtataccacattttacagttgaggaaattgatgcactgagcagttgagtaatgtgtccaagattacatactaacagatttgaactgaagcagtctagccctgaagtctatgttcttaaagacgtgtggttttacctctcattgtctgtagatttaacacagaaatttgagaattagctttgaggaaaataactagatgcttatctcaatgttaataaaattaagtatctccactgaaaagtgaaaaaaggaagtcttttttatgtttcaagttacagaatctgcatgacgcttaccttagtatagatgtgaatccggtcagtattcctacttgcacagaacattaaggtgtcatacactggcaaagtgtctgaactcttccactgttctattaaagaagacaaaagagaacctgaaggcttatctaccctctatctaaaatagcttattttaatcgtgtgtaggttagaacgatgaaatagctatatcaaaatatcaatatatttaacaaaaagtaattgtctaggcttgaaataaaactaccacggtaggccattgaagagcatattggcttatatggtaaccaattgttttacatttttgctaatgatctaacaagaaacaaacagattcagaattagctgaaaaaatacaagttggtaggcataaggaagaatttccaccaataagagctgctattggtcttgaaaaaatttagactaatctattccttttgctagagtagatttgagaccgaatgagcatcattttgattattagcagcaacatcgctatgttgagggccacttaaatgcctgattccctgtagcctggtgcctgacattcacaaaagaagataagcagacaagcttcttttctgataatctcttcttttttagccctttctcagtcctactgtccaatatattttgcaggagatacaggattatcaacgcaggtctaaataacaattatagttaacatttagtgagcacatacaatgtgccaggcactgttgtaggtacatacagtaacaccttttagaaataaatagtgcattttacataggaagaaactgaggcacgttaacttacttatggtcatatggctagtaagaggatgtaaaacctgcaagctggctccagagtctgtgctcttaccttctctcacagttcctcagtgatcttttaaagtactttcccagacctagaagtctatgatttgtttgccattctacttggcaatgtcatcatactattatttttctaatcaaggcattgcccactttacaaacttgatttatgaattattcccttattttgtaaattcaaaaacgcactttaacatctctgaaactggcatgtcttacagccaataacaacaatggcattttacaatcattgctggccatgtggcagttgtaaaatagttgtctttgccttagtatggatgagctgagtcatagctgtaatactattgtcacttttacactacacatgaggtatatgcattgttgctactatatgtatttactttattacctttaaaatgtctttaaattttttcactatgatttggtattgaaatgaaaagttatcatgtataccataaaacttggatacagaccaggaaagcataaacttggtattaaagaagcaaatgtgtatcactggaggaataaccaaaatatcttattttcttgtaaaggaataatggagtgcttcatggtactgaaggaagcaagagctctgcaaatagaggaaagtgtcttacattggttactgagatgttcaaaagggttgcctattacatgccaaagaaagcaactgaaagcaggagaaattgccaaatccctcagaataaatgaaagaaatgtccaagcaacagaggatgatgtggcctggcctgggctatcattaaggtattgtgtcatagcttaattggcagttttctttgaagaactatgcattaatgcttaaagatcagaagccattctttgataaaaataactgtaacaacaattccaaatcagttgatattaattcttgatagctatcagctatattagggaacatatttctcttttcagtgttgccatgaagtgtaaattaatggtttgagactatagatgatgcatctatggtcattcttccaaactcctggaattccagagagaacaaaactacagttctagagtagtatgtaccactctggttctaaaagagcatatgtaggtagaataagcatttaacatagtgtgcctactttgttttctgtttgtttttcatggaaatccatgttagtggaaagatgtgaagcatacctcttatgtggaattctcagcccagtgatctgaaaagtcaaaagagggaagcacgactaggtaaggggtaaatgctggcattgtctggagtgaatgagggcaaagcaaatttcactggcagaacaaaacttcaaagtgatttttaaaaaacatttgtaagtacaagctaacatgtttttatcaagagatcaatgtacaactaacaagccaatacttccctgccatagatgaagagactcatagcccaggtgatgacaattgccaggtgttggttcctagtctcatatttagttcactgagccatatgctgtcccattaccagagtttcatcagcacttgagagtttctcacagtgagatcaagaaaactagagacacaaaagagtataacccacctgagtctacactgtctacttaaaagctgttaaaattaacagatctaaacagatccattccaagacatgctttgggaagaccttgaggagttagaaggaaggctgagagaagaagaaagaaggatgccttgagctcagaaattcttaaatgaacatttcattttaaagctatgagtcagactctaaattatattagtgtttaatagcaactaacttagaagaaaagcttcaacagtctcatcccaactattgggtttatctgaataagaatatcaatctgtatgttactatggtcactaaatgagtaacaaggaaaataacccaaaagtactcagtctcttgccagctagcccataaacgatagtgaaatatgacatacaggctagtatttgctaaccatcacagctataaataatgaatggaatcaaccaaaaagtaaacaaacccaaaacactgtatggttggctacaaatgcagtcatgattcatacagtcttgacattatgttccctaaaaacattttctttaaaatacttttttaaaaatatgccaattaagtataactatttacaagaatttttgtgtaaaggattaatgatatgctaagtgttagttaattatctgtcagtcttactgttttgtcccaaagcacctcccaaatatcaaaacaacacccttactgtgtgaatgagctaggcttggttgaggctgggcaacaggcctggtggcagcacatgtagctatttatcggttttgctctatgtgtaatgtctgaatgccaacagacacactcagctcttctagacatctggtgtttaagtatgtggttacaaatggttggtatttttaatataaaagagagtaaaaggaacctggaacaaggtagtaattactaatctaataacagtattatgtgtgaaagtatatggttattacttggatgctagaaatggaaacaagacttaccattacctggctgggatgtaagtccgtcttctttctcaatttttggtgtttcttccttgctgtcagccaactggccaggttctgactgtgcaagggcttgtttttcacagtctgagatagtttgaacctttttggaggtgtctttctgagaatcatccttctcgtttttatcctggatatggttgaggctatctatttgcataactattaaaataaaaattattacaaaaatgtaataatttacatttaaaagtaaagtaaaaagaatgtaacagttaggtcttataaaaagaaagtgaataatgtttattcatatgttcaaaacatttatcaggagcatactatatacccagtactattctagatgctgaagagacagcaggaacaggacagagaaatccctgcattctagactccattctaaatggcagagaaagacaataaaattaacaaataggtaaatagtatattttcagataaagagaacacaactaagttttgtttttttttttttttcagtaagaaggttttggagagcactactatagcaaaagtcatgaggaccaagctctgagaggagtcccatttgagctgagagctgttcatggctctaggaagcttggactcgggcctatattcttggtctaaatattctaaatgtaactggaagccattaaagagttttaggcaaagaaataaaggatcactttggctgctgtgcactgaaggatcagattaatatggaggctattgaggtctgggagaaagatggtggctttagagtaggatggtagcaataaagataaagtggttggaatcaagatttatttggaggttacttgatgggttgagtgtgggaggcgagaaagagaccaaagatacagcccaagtttttagcatgatgtagtaaagaacagggaggagaagatttgggtatcagatgtggcagtggtagaaatataaatctaataattatattttttatatatagtaatatcactgttacttagactatgtatttctctctaatcagactttcttattcacaaaaggtagtttttatttttttaagttgcttgacagattccttattgaatcatgggtctagaaattttcattgttgctcttggtattgcaaaggaaaaatcagaactataaaacccatattaaattatgacttttgttgctaaatcattcaacttatacatttaatgtgaactaacattattttatagtcacaatagagcttatttttattgcctgtagcagttgggaattgcatgcaatcatgctaattgtgacagagatattacatggaataagcatgtgattccaatttagttcacagacaacaggtgcccacatacaaatataaccactcagagggcagacttgtcaattttggtgggagtacccagaagtgaaagagggaagactcagctcctccctacattttccttcaaatcaaaattaagacagagagaagagcaaggcaagaggaaggaactgcaatatcagaatttatatcttagctgagtctttgtcaatgccaatatttttttttttttttttttgagacggagtctcgctctgttgcccagcctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgccaatattttgaagagttaatgtatgatgcaaaattagatgtgtacaattattacaactgataaaatacaatgtgtacttccagtttccaaaactgtcaacttggcatttttattactataaaaatgctctatagaattggaaacaagaatacgcatgatctttttcttacgacaaccacgggtattaataatcatttcagaaactaaacatcagaaaatggtatcccatgctataaaaacatacttgaggtatatttatgatttctgactttaaaataatatgttttaaaaaagaataaactcaaaaaaaccagacatcaaattggttcacaaatgaagattgatccatagaggagttttgatgctttgacaagcaaaaaccatggcacaatgtatactgactaggcaaagaagctacattagattattttgccatttaaacataaaaataatccacaatttccttaaaaacaagtattagctacagaggagagaaaatagaaggtctatgagtataaggcatatttgctaccatagcaacagagcttctattcctgctcactgaattcatatcctgctgacattaatcagaaatgtccatttgtgccaaattaatgccatatcacagacgtttggggatatacattcttgacagaactgagagcttttcacattccataagggataaattcagtcttcactataagaagctcttattccaatttaaaagctaaagttgtgctgagtcacactaaccctggataacagcagtctctaaaagcacaggttatctgaagacaccactaacagcccttacctccatggtcaccttctatatactcaccagcactgccttgaggagtctcacacatttcacaataaggtaactctgaattattgatataggtgcagagactacattgccagccctctacaggaaaggctggggtggttaactgggccttggcctcctgtacactttccacgagtggagttcggatttgcttggactgggatggtgtctcttccgacggactgcagtggtcttccgaggcagccaatttcaatcttttcgtttcaggttcaacatcactttcataatcgatgatatctcttgcagctgtttttgtagggtctgatgacactacagtattttcctcccggaatctctttgattcgtcacaggaggtcatcaactgtctttttttaggttgtggtacaaaaaatgatcgaatatcatgctgtttttctttttcgaactaggaaaagcaaacagtagttatcaaagtaagaagcaatctaatatgttcttcttacataaaagagcttaacaaaatattttaattaaccatattgccttatcctttaaataccttttggaaatgaattcattatgctctgactcttcatatatacatatataaatatatatatgtaaaacatatccatgtacttcctgtgtctaacttttttctcagcacttattgtgtgccaagcatttaacatatattaactcatttaatcctcacatcagctctatgaagtcaatactagtattattataacatttcggaagaaactgcagctttagagaggtaagataacttggttagagcagttatataacaaaaatatacttaatacattaccctaaatatatgtcacggaaaaaaaggcaactgtgtattcaaatatttcaggtcaatcaaggacctaaaaaaatgctttcacacctaaaatataaacacaatgctcacacataatgttattcatatgaaaatgttttcttgaccaggaagctgttaattaggctgggtgcggtggctcatgccgataatcctagcactttgggaggctgatatggcaggactgcctgagcccaggagttcaagactagcttgggcaacacggtgaaaccccgtcactacaaaaaaacacaaaaaaacaaaaaacaaaccccaaaacaaaaattagccaggagtggtggtgtgcacctgtagtcccagctactcggggagctgaggtgggaagactgctggagcctcggaggttgaggctacagtgagctgtgattgtgccactgcacttcagctgaggcaaaggagtgagaccctgtcaaaaaaaaaacacacacaaaaaaacgggggatggagccaagatggccgaataggaacagctccagtctacagcttccagcatgactgaagatgggtgatttctgcatttccaactgaggtaccaggttcatctcactggggagtgtcagacagtgggtgcaggacagtgggtgcagcgcactgagcattagctgaagcagggcgaggcatcgactcacccgggaagcgcaaggggtcagggaattccctttcctagtcaaagaaagaggtgacagatggcacctggaaaatcgggtcactcccaccctaatactgcgcttttccaacggtcttagcaaatgccacaccaggagattatatcccgcgcctggctcagagggtcctacacccatggagccttgctcattgctagcacagcagtctgaaatcaaactgcaaggctgcagtgaggctgggggaggggcgcctgccattgctgaggcttgagtaggtaaacaaagtgcctggaagctcgaactgggtggagcccaccacagctcaaggaggcctgcctgcctctgtagactccatccacctctgggggcagggcacagccaaacaaaaggcagcagaaacctctgcagacttaaatgtccctgtctgacagctttgaagagagtagtggttctcccagcatgcagctggagatctgagaatggacagactgcctccttaagtgggtccctgaaccccgagtagcctaactgggaggcagcccccagtaggggcagactgacacctcacatggccaggtactcctctgagacaaaacctccagaggaatgatcaggcagcaacatttgctgttcaccaatatccgctgttctacagcctctgcttctgatacccaggcaaacagggtctggagtggacctccagcaaactccaacagacctgcagctgagggtcctgactgttagaaggaaaactaacaaacagaaaggacatccacaccaaaaccccatctatacatcaccatcatcaaagaccaaaggtagataaaatcacaaagatggggaaaaaacagagcagaaaaactggaaactctaaaaatcagggtgcctctcctcctccaaaggaacgagctcctcaccagcaacggaacaaagctggatggagaatgactttgacaaggtgagagaagaaggcttccgacaatcaaactattccgagctaaaggaggaagtttcagccaatggcaaagaagttaaaaaccttgaaaaaaaattagacgaatggctaactagaatacccgatgcagagaagtccttaaaggacctgatggagctgaaaaccatggcacgagagctatgtgatgaatgcacaagcctcagtagccgatttgatcaactggaagaaagactatcagtgatggaagatcaaatgaatgaaatgaagcgagcagagaaatttagagaaaaaagaataaaaagaaatgaacaaagcctccaagaaatatgggaccatgtgaaaagatcaaatctacatctgattggtgtacctgaaactgatggggagaatggaaccaagttggaaaacactctgcaggatattatccgggagaacttccccaatctggcaaggcaggccaacattcaaattcaggaaatacagagaacgccacaaagatactcctcgagaagagcaactccaagacatacaatcgtcagattcaccaaagttgaaatgaaggaaaaaatgttaagggcagccagagagaaagctcgggttacccacaaagggaagcccatcagactaacagcggatctcttggcagaaactctacaagccagaagacagtgggggccaatattcaacattctcaaagaaaagaattttcaacctagaatttcatatccagccaaactaagcttcataagtgaaggagaaataaaatcctttacagacaagcaaatgctgagagattttgtcaccaccagacctgccctaaaagagctcctgaaggaagcactaaacatggaaaggaacaaccagtacaagccactgcaaaaacatgccaaattgtaaagaccatcgaggctaggaagaaactgcatcaactaacgagcaaaataaccagctaacatcataatgacaggatcaaattcacacataacagtaataaccttaaatgtaaatgggctaaatgctccaattaaaagacacagactggcaaattggataaagagtcaagacccatcagtgtgctgtattcaggaaacccatctcatgtgcagagacacgcataggctcaaaataaagggatggaggaagatctaccaagcaaatggaaaacaaaaaaaggcaggcgttgcaatcctagtctcggataaaacagactttaaaccaacaaagatcaaaagagacaaagaaggccattacataatggtaaagggatcaattcaacaagaagagctaactatcctaaatatatacgcacccaatacaggaacactcagattcataaagcaagtccttagagacctacaaagagacttagtctcccacacaataataatcagagactttaacaccccactgtcaacactagacagatctacgagacagaaagttaacaaggatatccaggaactgaacccagctctgcaccaagcagacctaacagacatctatagaactctccaccccaaatcaacagaatatacattgttttcagcaccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccgcataactacatggaaactgaacaacctgctcctaatgactactgggtacataatgaaatgaacgcagaaataaagatgttctttggaatcaatgagaacgaagacacaacataccagaatctctgggatacattcaaagcagtgtgtagagggaaatttataccactaaatgcccacaagagaaagcaggaaagatctaaaattgacaccctaacatcacaattaaaagaactagagaagcaagagcaaacacattcaaaagccagcagaaggcaagaaataactaagatcagagtagaactgaaggaaatagagacacaaaaaacccttcaaaaattcaatgaatccaggagctggttttttgaaaagatcaacaaaattgatagaccgctagcaggactaataaagaagaaaagagaagaatcaaatagacgcaataaaaaatgataaaggggatatcaccaccgatcccacagaaatacaaactaccatcagagaatactataaacacctctatgcaaataaactagaaaatctagaagaaatggataaattcctcaacacatacaccctcccaagactgaaccaggaagaagttgaatctctgaatagaccaataacaggctctgaaattgaggcaataattaatagcttaccaaccaaaaaaagtccaggaccagatggattcacagccaaattctacgagaggtacaaggaagagctggtaccattccttctgaaactattccaatcaatagaaaaagagggaatcctccctaactcactttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggaagcaaggctggttcaacatacgaaaatcaataaacgtaatccagcatataaacagaaccaaagacaaaaaccacatgattatctcaatagatgcagaaaaggcctttgacaaaattcaacaacccttcatgctaaacactctcaataaattaggtattgatgggatttatctcaaaataataagagctatctatgacaaacccacaaccaatatcatactgaatggacaaaaactggaagcattccctttgaaaactggcacaagacagggatgccctgtctcaccactcctattcaacatagtgttggaagttctggccagggcaatgaggcaggagaaggaaaaaaagggcattcaattaggaaaagaggaagtcaaattgtccctgtttgcagatgacatgattatatatctagaaaaccccatcgtctcagcccaaaatctccttaagccgataggcaacttcagcaaagtctcaggatacaaaatcaatgtacaaaaatcacaagcattcttatacaccatcaacagacaaacagagagccaaatcatgagtgaactcccattcacaattgcttcaaagagaataaaatacctaggaatccaacttagaaaggaagtgaaggacctcttcaaggagaactacaaaccactgctcaatgaaataaaagaggatacaaacaaatggaagaacattccatgctcatgggtaggaagaatcaatgtcatgaaaatggcgatactgcccaaggtaatttatagattcaatgccatccccatcaagctaccaatgactttcttcacagaattggaaaaaactactttaaagttcatatggaaccaaaaaagaacccacattgccaagtcaatcctaagccaaaagaacaaagctggaggcatcacactacctgacttcaagctatactacaaagctacagtaaccaaaacagcatggtactggtaccaaaacagagatatagaccaatgggacagaacagagccctcagaaataatgccgcatatctacaactatctgatctttgacaaacctgagaaaaacaagcaatggggaaaggattccctatttaataaatggtgctgggaaaactggctagccatatgtagaaagctggaagtggatcccttccttacaccttatacaaaaattaattcaagatggattaaagacttaccatgttagacctaaaaccataaaagccctagaagaaaacctaggcaataccattcaggacacaggcatgggcaaggacttcatgtctaaaacaccaaaagtaatggcaacaaaagccaaaattgataaatgggatctaattaaactaaagagcttctgcacagcaaaagaaactaccatcagagtgaacaggcaacctacagaatgggagaaaatttttgcaatctactcatctgacaaagggctaatatccagaatctacaattaactcaaacaaatttacaagaaaaaaacaaacaaccccatcgacaagtgggcgaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcagggatgtagaactagaaatactatttgacccagccatcccattactgggtatatacccaaaggattatcaaacatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaactaaacaccacatgtcctcactcataggtgggaattgaacaatgagaacacatggacacaggaaggggaacatcacacactggggcctgttgtggggtgggggaaggggggagggatagcattaggagatatacctaatgttaaatgacgagttaatgggtgcagcacaccaacatggcacatgtatacatatgtaacaaatctgcacgttgtgcacatgtaccctaaaagtataactaaaaacaaaaaacaaaaaacaaaaaaacctgttaattaggacagcttctttagtagacacattttaataataaccttgttttcaagaaatgttatttcttttgtttaagaacagctacatcattgcatgtttttcatcttttcaatgtgtgaatctcagtttcctaattagagtaagtaggatacctatctccatggttaattagctacagttagggcaaattaaaggatttagtttcagaggtggagttgggaactatgttagaaacacagtgtggctgaatatattttcaatgatggtcacaccaattcttatgtcatttcacatgctcttcatacaatgtgacactgacatgcctccattgagaggtgggatctatgttcttcttccttgaacgtgagtagacctttgtaactgtctcacccaacagaatgcagttaaagtaatgctgtgtgactttttttttttttttttgaggcagagtttcactcttgtctcccaggctggagtacaatggcgcaatcttggctcactgcaacctccgcctcccgaaagtagctgggattacaggtgttcactatcacgcccagctaatttttgtatttttagtagagatggggtttcacctggttgcccaggtgggtcttgaactcctgacctgaggtgatccacccgccccggcccccacaaagcgatgggattacaggcgtgagccaccgtgcctggccaatgctgtgtgacttctgaggctaggtcattgaaggtaatatggcttcaacttggctggccctctgtctctccctttctttctctcttgggacacttgccttgggaacctagccaccattggtatgaggaaacccaggccacatggagaaatcctgcggtgttccagttgacagccccagaaaagctcccaggtgacagacagcaccaattgccagacatgtgagtgaacaagccttcagagaagttttcagcccctggcatgggtgtcttccatcaagggccacagtcatcatggaggagacatgtcattcctgttgtaccctggttgaatactgcacccatagaaactataagaaataatacaaggctattgttgtcttaagacactaagttttggagcaatttgttatgcagtaatagataactaagacagaccctgtagataatgatagcaaaataccatatattgtaaatgatattttacataatgaatattatctgtacttcttagtggtactatataagaaagaattataaaattcataaaaacagaaagattagtggttaccagaggctggaggggaaggggaaatggagagtgattgctacataattatagactctctggggtaatggaaaatttttggaaatactggtggtgggtgcacaacacactgtgaatgtaatgacactaactgtacacttaaaaatggttaaaatgacaaattttatttaccacagtataaaaaatcaaaaaaaaaaggaagcgaaaaaataaggaaggaaaatttaggctgttcccatatttgtaaaattaaaacatgttatcatagggaaaaagctctctcccctgctccactactcccaataatgtagaactcttattttgcatggctgctaatttatacgttctcaaatactacaaaaagttatctaattagttgtgaaatatacagaattcagataaatatagagaatgaaatcattaaccacaagacacgatttttaaaacaatgcgtgagggaaattaaagaaagagcgggccaggcatggtggctcatgcttgtaatcccagcactttgggaagctgaggcgggtggatcacgaggtcaggagtttgagaccagcctggccaatatgatgaaaccgtgtctctactaatacaaaaattagctgggcgtggtggcatgcacctgtagtcccagctacttgggagactgaggcagaagaaccgctcaaacctgggaggtggaggttgcatgatccaagaccacaccactgcactccagcctgggcaatggagcaagactccatgtcaaaaaaaaaaaaagggtggaggaaagcagagagattaatagactgatgaagtttggtgttttttaaaaaaaggtaacaggctgagtacagtggctcatgcctgtagtccagtacattgggaagccaagacaggaggattgtttgatgcaaggagttctagaccagcctaggcaacatagcaagatcctgtctctacaaaaaacagaaaaattagccaggcatggtggcgtgcgcctgtagtcctagctactttaggaggctgaggaaggaggattgcttgagtccaggagtcccacaccagtctgggcaacatggcaagaccctgtctcttaaaaacaaaatggtaacaaagaaacaaatagaattaaacatttaaagaaaatattctattctgcacaataaaacagcaaagagagcttgcagaattttgaaaatactagcaaatgttcagcaaacatgcacaaattctatcagctatttctagttaaaccatactgtttttctgatagaggtaaactttctgtccttgcctgtctagaaatgagttgattttgtcctcatctttattcagtagttttgctgggcatacgattctccttgaatccttcctttttgagacagggtcttcctctgtcacccaggttggagtgtagtggtgcaatcacagctcattggagtcttgacctcctggattcaagtgatcctcccacctcagcttcccaagtagctgggactgcaggagcatgccaccatgcctggctaatttttgtatttttttgcagagattgagtttcaacatgttgcccaggctggtcttgaactgttgagttcaagtaattcacctgtcttggccccccaaagtggtggaattacaggcgtgagccaccatgcctgacctctcaaatccttaaaggcattgttctgtttcttccaatatctgttgttgctgaaaatgttgttccttggtaggctgcacatttttgctttcttttagggcttttcaggaacttttatttttggtgttttaaaatttcacagtgatttacctctatatagtctatatttatatgcctttaaaaattctgctcaggacttaagataccttattaattttgaatactattatctttagctctcgaaaatttctattattctttgatagttccttcctcttaattttctctttttctggcattcctattagtagaatgttagacttacacatttatgtcttaccttttactgtaatattttccttctttttgtctttttaccctgtaaactcttagttttcctctacttatctttcaacccttctatagaatcattttagtttggcagtcatatttttaacatctaaaagttccttgttattctctgttcttttttttttttttttaccgtattctcattttatttttatgggcaatataatctcaaatctgaaactactacttaagagtttttttaaaattatcttcaggatcaatttgtgtattagtttacttttgtttatctttttcatgctatagattttctcttcaaatgtctaatgacacttgatcgtcccttccttgagggatgaatggggaatgggagggtttcctgggaacttaggacacatggggctagcagcaagaagatctgatgggacatgctgactgaacatgaggggtgaggaagatgcaggggcctagagtaatcttcagactcctagatttttgacttgtaacatggtagggatgatattttcagttactgcaatagaaaatacagaaagataaataggtacattagaagaccaaaaaagaagagctaaggaaacaagttcacttttagaaatgtatgagaactagtggtactggagtagaggattccaggaagcaggtttggagttcataagagagacaactgaggccaggcatggtggctcacgcctgtaatcccagaactttgggaaggtgaggtgggcgaatcacttgaggtcaggagttccagaccagcctagccaacgtggtcaaaccccagctctacaaaaaatacaaaaagtagctgggcatggtgcgcacgcctgtaattccagcttcttgggaggctgaggcacgagaatcgcttgaactcaggaagcagaggttgtagcgagccaacttttgcctctgaactccagcctgggtgacagagtgagactctgtctccaaaaaaaaaaagagagagacaattggatttaggtatcagagaacaatcatggacatgcaggtggataaaatcataaaagtggatgtcatgccacatagaggtagttcaataaagtaagaaaaggtaaaaaggacagaaaacaagggaacaaaattaatggctgaatgagtaaaagatatccagaagaaaactcaaagcaaaaaatcaggagggtaatggctttagtgtgtgtttcggttttccattcattatagtagacactcagtaggtactttctttctttttttttttttaaagagatggggtctcagtgttacccagggggggctcaaactcctagggcacaagcaatcctcctgctcagcctactaagtagctgggacctacaggcacaccactgcacctggctttcggtaggtactttcaatcagatcaacttgtgtccttccgtcctgggaagttttcttaaattatttttttcttcctctatcttatctttctagatctcctattaggaaaaaagcttctgaacagattatttaattttcttcacttttcctatatctttgttctacttctgggtaatttcttcattatcctcctttctttccttatttaattattaatttctggtattacagttttaagctctaagagcttgttgtgttctctgatttttcctttttcttattcatgtttcatgagcacactgtttttacttatctgtgtctactgatggtagttttttgttctgtttttacattttcttcagctcattacattgtctctgtttcttttgtatctcattcttggcttacatgtttgttttggtttctgtttttcacatgagaggtggccttctgttatccactgatatttaataagatgctaaaatgctatcaggagttccacatgggagacttcactgtagggtcatcacagactcttttatgatctccttcagtctccacaagtttttgcttggtctagtcaatttctccacagatgacacaatgttagctaccacggagctgatcagagaaaggtgctaaagaggctgggcgcggtggctcacgcctgtaatcccagcactttgggaggccaaggtgagtggatcatgaggtcaggatttcaagatcagtctggccaagatggtgaaaccccgtctctactaaaaatacaaaaattagccgtgcgtagcgttggcgcctgtaatcccagctactcaggaggctgaggcagggaacccggcaggcagaggttgcagtgagccaagatcgtgccactgcactccagcctgggcaagagagtgagactccttctaaaaaaaataataatttaaaaaaattaccattaattaaggaatctttcttaatctgcttgttttcaatttaatgccttaaccataccctcaaccacctctcttcctgtacttaaaaaaactttttttttctttctgaagcaggttctttctttgtcaccaaggctggagtgcaatggtgtgatcacagctcactgcagccttagccttctgggctcaagagatgctcttgcctcagcctcctgagtagctgggactacaggtgcatgctgccatgtctggttaatttttgttgttactgtttagacaagggtctccctgtgttgcctgggctggtcttgaactcctgggctcaagcgatccttctgccttagcctcccaaagtgctggaattaaaagcatgagccaccatgcccggccttaaatttttttttttttaagaagagcaaataaaacaaactgatgtcagcatagctatatatataaaatatataatagtccactatcatctacactgaataatgtttaaataatacttgaatcttttgtcctattctatattttaaagaatctgtttatttaatgacttatgtctccatttccccaccaaaaaaaaaaaaaaaaaatttgcaacatttgttaaaacaaaaggaatcttcccaacaacaaaacagaacaacaaagaaggctgaacgtggtggctcatgcctgtaatcccagtactttgggagtccaaggcaggcagatcacttgatctggccaaacagatcaaaccaccctggacaacatatcaaaaccccatctctactaaaaacacaaaaattagctaggcattggggctcacgcctgtaatctcagcactttgggaggccaaggcgggcagatcacttgaggtcaggagttcgaaaccagcctggccaacacggtgaaaccctgtctctactgaaaatacaaaaaaattagtcgtgcgtggtggtgggtgcctgtaatcccagctactcgggaggctgacgcacgagaatcacttgaacccaggaagtggaggttgcagtgagctgagttcgcaccattgcactccagcctgggtgacagagcatactccatctcaaaaataaataaataaataaataaataaataaacaaacaaaacaactaaagaaacctccccacaaaaaaagaattctcagggccttcaaataccagctttacagttgatcttcttaattaagctatttaattaagctattttaaaaataacttattttactatttaagcaatgacttattttgggaaaatagcatttgagaattctcattatatgctgaaggcaggttgagaggtaaggttagcagtgactgacagtaatgagaaactgatgcttacttctgccattatggtagtttatgaacagtggcatgggagtaatcagcataggtgatgttctaaaacagaacattccacttgggtaataaaattgaggctttagtacataaaatccagaaaacaagggaaaggatagaaaggaaatcattttaataatattgtgaaccaaaaggtactcttaagaatacaatattagcaaaaggagagagcaagattagcaatgactatggctaatgttatgatggctaaactgaacaatgatgaatgctgtcacaggaagtaaaccttacaagttagggtcctggccatagggctgccataagctggaaggcctaaaaggagtaaggatttcctatgaggtaatcagtgagaaacctgatccatgtcatcaactgtgctttctgattgtagcctctgggcaatcagcaggaagttggttgaggtctctttgacatttagcagctatgactaatagaaaaacaagtgagaaaatctctttgatatattctaaagataattatacctgctggatggaaacaaagagggtctcctggtttactgaaaatgattttttgttttgttttttgaggcagaatctcactctgttgcccaggttggagtgaagtggcacaatcttggctcaatgcaacctccgcctccctggttcaagtgattcttgtgtctcagcctcccgagtagctgggactacaagcatgtgccaccatgcctggctaattttttgtatttttaatagagacaggggctgggtgctgtggctcacgcctgtaatcccagcacttcgggaggctgaggcaggcagatcacctgaggttgggagttcgagagcagcctgaccaacacggagaaaccccatctctactaaaaatacaaaaatagccgggcatggtggcacatgcctgtaatcccagctacttgggaggctgaggcaggagaatcgcttgaacctgggaggcagaggttatggtgagccgagatcgcgtcattgcactccagcctgggcaacgagattgaaactccgtctcaaaaaaaaaaaaaaaaaaaaaagagacagggtttcaccatgataaacatctgaaggtggacttgtggtttgaatagctccatttcttttcttttcttttcttttctttctttctttttttttttttttttgagacagagtcttgctctgttgctcaggctggagtgcaatggtgtgatctcggctcaccgcaacttccgcctcccaggttcaagccattctcctgcctcagcctcccaaagtgctgggattacaggtgtgagccacagtgcctggccatccttgatgttttgagacagagacatatcaccatcaactcatggagactcaagcaggtattgggaacatgtctggtttataaaagaagaaggtgaccttaaacaagatactaatttgtagatacagatatcaaataaaaatatgcttctaatgacttttctgttgtctttttttgttaatttttcataaagtgttctcttttagtagagctggcaacattgctacagctgttagtagattcactgattaaagcatttgggaaaaacatagtaagaaataattgcaaacagaatgcttcccaaaaaaatgcatattttccaaaaatgttagattcatcaacaacaatgactccctgctccttaaagaaggaagagtgatctaagcctatagtaatttttatcacaaagcttatgagaaaaatataattataacaacacgcccatgtcataaggaaagtggaagatagaagaacatattcctctcttcagttatacagctgaaactcagttattatgttcctgtcttttgttcaatattgtttttgaaaaacaaaagaaaaatactgcttttggtgagaagtgctgggaatacaaactgcaaaatgcttaagatggcaaaatgcatgtttttatctgaaaagttcagagtcctaatctttttgccctgtttttcaccatagcaaactactggtctttacagacaaatcccctggctatgatgataggattaaaagccagttattagaactgaaggagaggggaaaaaaatctagtaaaactcataaaaaataaagcacttcaaagcttggtgccattccagggaagcacaggctaccaacaaaagcactgatgtcaagtttaatagactttgatcaaagggcagctctggtaggaaccattactgcctcgtgtcatttggctcctgttcctaaaaatattaataaacctattttacaaatgggtgattgggacatcatgctggtctcttgaaccacagaggattgatgattggaactggaactaaagagccctcgtgagcatttgtaaacaagccaacaagagtctgttttcaaaggagacagagtgacacaagtagggttttaatcatctaactgaaaaaatagatttaaattattctaagaaagaaatgactggtttttttttcagattttccaaaatgttcattcccatacagctgaataaaatactgacaatatccactcttaggcacaactactagtgtttctctgcagatagagagaaaacaaaacaaaacacacaaaataaaacacattttgattttttttaaaacccaaagtagtaaaaaagaaaacgttattacttattattatttttttttagagacatggtcttagccaggtgcagtgtcgcatgaagtgggaggttagactcctgtacatatccctaggaaagaggctgaatgcaggtggataagcagcaacagcctgcaggccccatttccacggcaactcacttccatggcacctctaaaattccaatcagctaccagaagtgtcattgcacctccctaggaaaggaggtcctgaggggaggggctagtcaccatgtttgctgtttgggcaccttagctgttccagtcttccagctttggagagtccaagcgaaagggagtgtggagggtggaagggatcccccagcacagcacagctgatctaccaaaatgtggccagactgctttttttaagtgagtccccgatcccattcctcctcactggacagaacctcccaaccagatcaccagctacctccttcaggtgcctttggaccagcaacaggcctgtacctccctgggatgaagctcctagagggtgggataggctgccatctttgctgtttcacagacttcactggtgatacctctaggtactggaaaatctgaggtgactagggactggaggggccctcagctactttagtagccctacagaaaactggccagactgttacatgggtgcccattcccatatctgctcattgggtaggtcctccaagcctggggctctagccatccgccaccagagctattgagccagtagctgctcggcaactccctgtacagagcctccaggcccaaaagtataaaagccctgggagacaacataggcaataccattctggacaaacgaatgagcaaagttctcatgacaacaccaaaggcagtcttaacaaaagcaacagttgacaagtgggatctaattaaacttaagagcttctgcacagcaaaataaactatcaacagggtaaacagacaacctacagaaaggaataaagtatttgcaaactatgcatctgacaaaggtctaatatccagcatctataagaaacttaaacaaatttacaagagaaaaacaaaaaattccattaaaaagtgggcgaagggcctggcatgttggctcatggctataatctcagcactatgggaagccgagatgggtggatcacctgaggtcagtagtttgagactagcctggccaaaattgtgaaaccctatccttacaaaaactacaaaaattagctgagcatggtggcgtgcacctgtagtaccagctactcaggaggttgaggcatgcaacttgcttgaacctgggaggcgaaggctgcagtgagccaagattgcaccatcacattccagcctgggtgagaaagcaagactctgtctcaacaacaacaacaacaaaaaaaagtaggcaaaggaaatgaacagacacttctcaaaagaagacatatatgcggccaacaagtatatgaagaaaagttcaatattactgatcactagagaaatgcaaatcaaaaccacagtgagatacgatctcacaccagtcagaatggctattaaaaagtgaaaaaaataacagatgtgggcaaggttgcagagaaaagggaacacatacactgttggtgggagtgtaaattagttcaactattgtggaaagcagtatggcagttcttcaaagggctaaaagcagaactaccattcgaaccagcaatcccattactgggcatatgcccagaggaatagaaatcattctaccataaaggcacatgcacaggaatgttcactgtagcactatttgcaatagcaaagacatggaatcaacagaaatgcatgtcaatgacaggttaactgaagaaaaagtggtacttatatgccattgaataccatttagccataaaaaagaatgatataacgtcttttgtgggaacatggatggagctggaggctattatccttagcaaactaatgcaagaacagaaaaccaaataccacgttctcacttataagtgtgatatggtttggctgtgtccccacccaaatctcaacttgaattgtatctcacagaattcccacatgttgtgggagggacccaggggaaggtaattgaatcatgggggccagtttttcctgcgctagtctagtgatagcaagtaagtctcatgagatctgatgggtttatcacgggtttccgcttttgcttccttctcattttctcttgccgctgccatataaagaaagtgtctttcgctgcctgctgttgattctgaggcctccccagccatgtggaactttaagtcaaattaaatctctttttctacccagtctcaagtatgcctttatctgcagcatgaaaatggactaatacagtaaactggtaccagtagagtggggcgttgctgacaagatacctgaaaatgtggaagcgactttggaactgggtaacaggcagagactggaacagtttgaagggcttagaaaaagacaggaaaatgtgggaaagtttagaacttcctagatacttgttgaatggctgtgcccaaaatgctgatagcaatagggacaataaaatccaggctgaggtggtctcagatggggatgaggaatttgctgggaactggagcaaaagtgactcttgttatgtttcagcagagactggaggcattttgcccctaccctagagatttgtggaactttgaacttgagagagatgatttagggtatctgacagaagaaatttctaaggagcaaagcatttaagaggtgacttgggtgctgttaaaggcattcagttttataagggaagcagagcatagaagtttggaaaatttgcagcctgactatgtgacagaaaagaaaacttctcgggagaaattcaagccagctgcagaaatttgcataagtagcaaggagcctaatgttaatccccaagaccatggggaaaatgtctctaggccatgtcacagaccttcatggtaggccctcccgtcacaggccaggaggcccaggaggaaaaagtggttttgtgggccaggtccagggtccctgtgctgcgttcagcctagggacttggttccctgcatcccagctgctccagccatggctgaaaggggccgacgtacagcttgggctgtggcttcagagggtggaagccccaagccttggcagcttccatgtggtgttgagcctgtgggtgcacagaagtcaagaattgaagtttgggaacctccgcctggatttcaggagatgtatggaaatgactggatgcctaggcaagtttgctgcagggttggggccctcatggagagcctctgctagggcagtgcagaagggaaatgtggggttggagtcctcacacagagtccctactagggcactgcctagtggagctgtgaaaagagggccacctgtcctccagaccccagaatggtagatccactgacagcctgtaccatgctcctggaaaagccatagacactcaatgccagcctgtgaaagcagccgtgagggaggctgtaccctacaatgccacaggggcagtactgcccaagaccatgggaacctaccttttgcatcagtgttacctggatgtaagacctggagttgaaggagatcattttggagctttaaaatttgactgcctcactcgatttcagacttgcatgggccctgtatcccctttgttttggccaatttcttccatttggaatagctgtatttaacctgtacccccattgtatctaggaagtaactagcttgcttttgattttataggctcataggcagaagggacttgccttgtctcagatgagactttggactgtggacttctgggttaatgctgaaatgagttaagatgttgggggacttttgggaaagcataattggttttgaaatgtaaggacatgagatttggaggggccaggggcggaatgatatagtttggctgtgtccccacccaaatctcaacttgaattgtatctcccagaattcccatgtgttgtgggagggacacaagggtaggtaattgaattatgggggccagtctttcctgcgctattcttgtgatagtgaataagtctcatgagacccgatggttttatcaggggtttcctcttttgcttccttctcattttctcttgccgccaacatgtaagaagtgcctttctcctcctgccatgattctgaggccttctcagccatgtggaactgtgattccaattaaacctctttttccgctgggcatggtggctcacacctgtaatcccagcactttgggaggctgaggtgggtggatcacaaggtcaggagtttgaggccagcctggccaacatggtgaaacctcgtctctactaaaaatacaaaaattagctgggtgtggtggtgtgtgcctgtagtcccagctactcgggaggctgaggcaggagaattgcttgaacccaggaggcggaggctgcattgagcctggatcgtgccactgcactccagcctggcgacagagcaggattccgtctcaaaaaaacaaaagaaacaaacaaacaaaaaaaccctctttttcttcccagtctcaggtatgtctttatcagcagcataaatggactaatacaaaatgggagctaaataataagaacttatgaacacaaaaaaggaaacaacagatactagggtctacttgagaggggaggttgcatgaggaagaagagcaaaaaagataactattgggtactgggcttaatacctgggtgatgaaataatatgtacaacaaacccctgtgacacatgtttacctatgtgtcaccttcccatgtgcccccaaacctaaaataaaagttaaaaaatataaagaaaagattaaaaagattattttgtagaaaaaaatcccatgacatcaaaagtagtatatgcaaatgcctttgggaatggctgtctcttccaataaggacaatgagaatttatagcaaaatatcatataacatatagattattagaatgtaactcagggggttaaattaatccacttatgtctagtgtgtacctatgtaccattatttctctttaagctctagggctgagctccaaatgactcttggacaacagctgaggttcagagacacctcaaactcaagatgtcctgagtgaacccttcacctctgtcctgaagccagctcctcttctaccaccacaatcttttggctcttcactgctcatccaaattaactataaagtcctctgcatggaaatctccagttttagactaaattagatctctttctgttgtttcaatttgtcctctccttatctacctgcatgctgttggctgtggtgttttccttaagtgcctgcttcaatcccttctactctttttgcactgctgctattagataggattccactcaggtctcattttattgattctactgctgaaatgtctggcattttttgcctctctattgtcactaccactattaggaattcagggtggttatagtgcctcaaatcccctctaggaatccttgacaaaggggctttatacataccaatagcctcatgaataaaaaggaactggctttattagtagacctgtaagtgcctgatagtaccaaagtaaaattctggtaaaagctatattgaagaacccagctagaacccaaggtcaaaagtagacttcctaacttgtcagcacagatctagcggcagaggtggtggtagggcctgccaacgcaggcttgtttgctgtgctcacagtggaagcagaaagcaaaggagaggcatgcctcctgggggaacagtaactcacctaccttgaactgtgacccaaccaagttctcaggctctaaaaatcagggggagaaagcctggacagggagtggagagagagagagagatcccttcaccataggctgaaactagatgggagactatactatgctttgcttaacaacggagatacagacacactccgagaaatgtatctttaggtgattttgcagttgtaccaacatcatagagtgtacttcacaaacctagatggtatagcatactatacacctagactacctggtatagcctgttactcctagactataaacctgtacagcagttacagtactgaatactataggtaactgtatcacatggtgagcatttgtgtatctaaacatagaaagggtaatacattgtgctaccatgttactatggctacaacctcaccaggtgataggaacttttcagctccattataaccttatgagacttccattgcatatgtgatcgtagttgaccaaaacattattatgtggtgtatgactgtaatccattcccaagtagcactgcctccaagaacttctgtctcttcacccttccatttgtttttcacactaccattaggactatcttttgaagacagatatctgatcatgttatttatctgcttaaaaacatctcatgacactacatacttccagaatcaggtctcactttttggcatggcaagtgtgagttcctctccaactggttactgctaaagttttaggcttcctctcctttaactcacttctcatgtgccctaagctcacatatttgtgtagattttgcattctcagaacaattaatatttgttcatatctctgggcttttaggcatgcttttggtgttccctctgcctgaaattggacctactgcctctgaattcatccttcaaaatccagctcagatatttcctaacagaaactttctcaaatgctccaggtagttatttattctgtcctgtgttcccagagcctggcttacatgtctctattttcatatttatcgtattgcattaaaatgatttgtttacaactgttttttcctaactaaagagtaagccccaaaagaaagttagctattttccttatcttcgcattctcaaaatttagcatatagtcttttaaaaaaaaaacagctttggccaggtgtcgtggctcacgcctataatcccagctacttgggaggctgaggcgggagaatcacttgaacctgggaggcggaggttgcagtgagccaagatcatactactgcactccagactgagcaacagagtgagactcagtcttgaaaaaaacaaaacaaaaaacagctttattgagatataatccatataccataaaattcacccttttatagtgtccaattcaatgattttagtatattcagactttggcaaccatcacccctgtttaattgtagaacattttcttttttttttctttgagacagagtcttgctctgtcgcccaggctggagtacagtggcgcgatctcagctcactgcaacctccacctcccgggtttacaccattctcctgcctcagcctcccgagcagctgggactacaggcacacaccgccacacctagctaatttttttgtatttttagtagagatgggagttcaccatgttggccaggctggtcttgaaatcctgacctggtgatctgcctgcctcggcctcccaaagtgctgggattacaggtgtgagccaccgcatccggccgtagaacattttcattaccctcagaaagaaaccctatactcattaggcaatgttaaataaaatgtatgtgaagccattgttttagtctcagctcctacactaggacccaaaagaccagaccaaaccaggatggagtaacacatgctaggtgccacttaatcaaactgaacttaaaaacaggccagtttagaaaaacaaaacaaaacaacacacacacacacacagacacacacacacacacacagcccccagggattcatggcaatcaaaaggggcccagtcaacctgaaccagcatgatgaggaagttctctctgctttacccctacaaagaaaataattttgaaactattaatctgcttttccttccttgtttctgcttccttttctgttccttgtttctccttttctgcctataaaactcacccactctgctctgctcagcttagtgaagcatcattctagttcataaacaggatgctgcccaattcatgacttgctaataaaaacaaatcagggccaggtgcagtggctaacgcctgtaatcccaacagtttgtaaggttgaggcaagaggactgcttgagctgaggaatttgagaccagcctgagcaacataaggagacccccatctctacaaaaaataaaaaattaacctggcatggtggcatgatgatagtcctggctacttgggaggctgaggcagggggatcactggaccaggatttcgaggctgcagtgaactatgacctctccactgaacaatcctgggcaatagagtgagagtctgtctcttaaaaacaaaaacaaccctcctcaaacaaaaaaaacccaatcagatatttaaaggtcaactcattaaaatttttttttttttttttttgaggcagggtcttactttgtcacccaggctggagtgcagtggagaaatcacggctcactacagactcgaccgccctgggctcaggtgatcctctcacctcagcctcctgagtagctgggactacaggcatgtgccaccatgcccacctgatttttgtattttttataaaaacagggttttgccatgttgtccaggctaaattttgttctttgacagcagtcactgcccatcctctccttgaatctcttagcaagtactagtctattttgtgtctctatggatttgcctattctggctaatctgaataaaaagagccatacaagaagtggcctttatgtcctgcttctttcacttagcaaattttcagggttcatccatggtgtagcatgtatcttttttttgtttgtttgtttttgagacagagtctcactctgttgcccaggctagagtgcagtggtacaatctcagctcactgcaacctctgcctcccgggtatagacaattctcctgtctcagcctcccgagtagctgggattataggcgcaagccaccaggcccagctaattttgtatttttagtagagatggggtttctccatgttggtcaggctggcctcgaactcccaacctcaggtgacccacccgcctcagtctcccaaagtgctgggattataggcgtgagccaccaggcccagtgcatgtatcctttttaaggccaaataatattccactgcatgtgtcagaggcatttgaaccagagcaactccatcttgaacaggggcagggtaaaatgaggccaagacctgctgggctgcatttcaaggatgttaggcattcttagtcataggatgagacaggagcttggcaggactggtttcacaacacacaggtcccaaagaccctactgatataacagcatgcaataaagaagccagccaagacccaccaaaaccaagatggtaatgaaagagacctctggtcatcctcacagctcattatatgctaattataatgcattcacatgctaaaagatattcccaccagcaccaaaagagtttacaaatgccatggaaacatctggaagttaccctatatggtctaaaaaggggaggaaccttcagttccaggaacttgcaaccctggaaaactcatgactaatctaccccttgtttcacatataatcaaggaataaccataagcatactcagtcaagcagcccatgccactgctctgcctatagagtagccattctttagtttctttacttctctaataaatgtcatttcactttactttgtagactcaccccaaattccttcttgcatgagatccaataaccttctcttgaggtctggatcgagacccctttctggtaacatatagattaaccacactttgtttacccattcatcaatttataactttttttggtctaactttttttggctactatgaatcatgctgccataatgtccatgtccaagtttttgtgtggacaggtgttctcaattctcttggatgtacgattgctgggtcatatggtgactttatgtctaacatgttgaggaactcccagatggttttacaaaatggttgcatcattttacattccaatcaacaatatatgagtcttctaatttctctacatcattgccaatacttgtcttttttattttagtcatcctagtgggtgtgatgtgataatctcattgtggttttgacttgtatttcatataatcttaatagatgtttatataatgaatgatctttgaatgtcctgtatgtggctcacatcccagaaacttggctaaaccaaattgaagtttttcaatgttgtattcattccacatacatttattgaaggcccatgatatgctaactctaatgcacctagtatggattggcaaagttatgagaacagaccttgaagcagaaaggcctggcactttctgccccagctgtgccacttattggctgtatgacctcgggcagattatgtaacctttctcagatttagtggggcaagttaatagtatcttcctcatgatgttgctctgaaggttaaataagatcatgagcctggagtggtagctcatgcttgtaatcccaacactttgggaggctgaagtgggaggactgcttgagcctaggagttcaagaccagcctggacaacatggtgagatcccatctttatttaagtaagttttttttttaaagaaagatcctgaatgttaagggcttagcacagtggctgcaagaaataacaactcaatagatgttagtcattattattgagtgtattaaaagtcataaaagtaaataagacaaatgtctaataataacataatgttatgtaagctattgagacagtgaagtaaaaagggctccctggagaatctccaacctgcctgtgcattgggaggatgtggtggagccttggggagttagcacccattgcaggaaggaggagcctgccctctcctgttcctgggtggtaaaaggggattcaatctgtgaagcgcaaagcctgctagcaggactctcacctttgctgagagtccctgtttcccttttatttcttttcacacaataaatgctgcccttctcaccctacaatgtatccgcatgcctaaattatcttggtcgtgtgacaagaacccgggttttcctacaacactacgacatagacatttgtatgtctctatctgtaacaatgaggctgccctcatgtccttatcaattaggctattatgcagactaattacataataattacaaagtgctttgaattcctaaaatatatattaaataaatattctcatttaagatgtgctgccccaagaaaccagttctttaccatattcagaaagaagagattttggacaagagggatttagatttcacaagtgccacagctcctgtggtcaactttctttttgctgttaccatgtattcaactggacaatatgcaggaaaaaaagtttattttttgtatatacgagacatttttaacttgcactttttaccacaacaaagcaaacatttcatacaatgttggcatttaatttaaaaacgtgttttctttttgaattttgagaactttgtttcgtttttgtttgtttttgagacagggtctcactctgttgcccaggctggagtacagtggtgcaatcatcctcctgagctcaagcaatcctcccacctcagactcccaagtggctgggactacacgtgtgtaccaccatgcccagctaattttcttatttttatttttttttaatgagacaaggtctagccatgttgcccaggcaggtctcaaacatctgggctcaatggagactcagcctctcaaagtgcttggattacaggcaagagccaccgctctggcctgagggcatattttaaaatttcataataatgctaaagagctctcctaactacatacaatcttttgcagcagacaagcaaccattctacatatttttatttatttattttttgagatggagtttcgctgttgttgcccaggctggagtgcaaagatgcaatcaatttcagctcagcacaacctccgcctcccgggttcaagcgattctcctgcctcagcctcctgagtagctgggattacaggcatgtgccaccacgcccggctaattttgtatttttagtagagatggggtttctccatattggtcaggctggtcttgaactctcgacctcagctgatccgcccgcctcggcctctcaaagtgctgggattacaggcgtgagccactgcacccagccagaaagcagacatgtcctaaccacaagcaggactcattacccatactaaattagagtcctttttttttttggctcacctatgaatcatttatgcaccaagattctcttaggatactttatagtttatatataatggatgaaagggggcttagacgccatctagtaatctagtgactcaaatggctagataaataatgttgctgattattggagaaaggagcaaaagaggaaaagaaaaggccctaaagaggttaagggaagggccccaatttcccacagctagagctagaggaagagatacttgttagatgaaggcagcaaaatgaaaaccagagagagaaggaggctccctatttgaacactccactcagcttgctttattcagaaacagcctttcgttgcttagaaataacatacactaatattatctataccattctcctgcctggagatgacctacattatcactcaatggaagccactgtagagaaatcaaaacacctcaaagccaaaatagtacttagaagtcagacacattcagatgtagaagaaaggaagaagcagtggaaattggactgaccacatcttaggcagtgaccctggtgatggactccaaggcaagactgcttacttatgggacagccaactgggctgtgcaaaagtatctttccttgtggtggtggaattttttcttttcacttgagttggacttcaatttgagtttcatttgggttaataaatactgtaatttcttaaaaaatgtaaatacatctagcatgggtaaagaattgtgactcatacatttgtgtggattagtttcatttaaggtattattcaaatacttgaataatatatattcaagtatatatatattcaagtatatatagtatatatgtactatatatactatactatatgtactatatatgtactatatatacttgaatttatatatacttgaacatatttatatatatacttgaatatattattgactattatatattcaagtatatatatcaagtatacttgaatatatatagtatatacaaactatatatattctatatactatatatattcaagtttatagtatatatatactatatattctatatatatactatatatattcaagtatatttgatatatataatatatactatatatacacttgacatatatattgtatactatatataaagattttgtatttttgtatttttattctatatatacacttgatatatatattatatactatatatgtagtatatatatacttgaatatataatattcaataatatactgaaatatccacaagctgttaaaaaccatccaattagaactgataaaaatttttgagtcaaagaagtttttgatgtcaaatggcaagtttggttaatctaggaaagtttaattgaaagttgaaagttttctaaaaatggagatgctggaaatgtcctttaaaaggctttgtaaatggataaaaaataaatcaaattcataggaaaattcccgttggaaatgctgaaattctggcaatgttcagaagaaaaataagttaatcagtagactaaatttccttagtacctgccaacaaattgaacatttcttaaactgcatgaagctgggagggtatagacagagtggtgagagggcacacccacctaaagtcaatcaaagcacacttcacttgttggccatacaataaataagcaaataccaacaaagcaaaactaaccaaaaccaacaaaagatccctacattctaagattccaatttacatcaaactgcgtctgtataaagacaagtattggaaaatctataagacaacactaaactatgaaagacacatacctaactcaagaaagtaaaatttggtatgggtgattttttaaaattgtgtatacaaatatatatttttcttcagataaacttttgaaaacaataaacatacacatatgtaggaagatttatttcaaattcttaatatctagcttagaaatgaacttgtaaacacagtttgataggaaattttagagaaagaacagctacaaatcatagatttatttatatatttttaaaatagctaggatttctattgactttattgtagaccagaatataatataataagcattgttgaaagaaaccttggctgggcacagtagctcatacctgtaatcctagcattttgggaggctgaggtgggcagattgcctgagctcaggagctggagaccagcctgggcaacagggtgaaaccccgtctttaataaaatacaaaaaattagccaggcgtggtggcgtgtgcctgttgtctcagctacttgggaggctgaggcaggagcattgcttgaacctaggaggtggaggttgcagtgagccaagattgtgccactgcactccagcctggcgacagagtgagactccatctccaaaaaaaaaaaaaaaaaaaaacaaagaaaactcttttttaaattaaaagaaaatcttacaaataatctaatttttagcaatatttgacggaattacattctaatattctagaaaaaaattgtactagacctccaaataagataattaaaaatttaatacaattctacataaaataatgtatttttatgcaattaaacttcacattaaatttttaattttgtattatcagaaaaatgtaaatattaattttattcctataatttctgatcagttctttgaaaaattaaaattaaactctctataactttgacaccatattacctcaaaaagactagaaggccaagagtggtggcggttcatgcttctaatctctgtgctttgggaggcagaggtgggaggattgcttgaggccagaagtttgagaccagcctgagccacgtagtgagactctgtctctatgaaacataaaaaattagccagaaatggtagcacatgcctgtggtcctagctactcagcaggctgagatgggagaatctcctgagtccaggactttgaagctgcagtgagctataatcatgccactggactccaacctgggtgataggcagagagcctgtcttttaaaaaaataagaattaaaaaaaaaaaaggctaggaaacagcagacattataaattacaaatttctctaatatattatttcttattaaatttataaataatctgttataaggtgagactgggggattttacatatagcatttgttagaggtgagactgggggattttacatatagaaatgtatagtgaatataacaaaaatctatatatccaccattcaaaatttacaaatattaatattgtacttctgatctttttataaaataaaagaaataaaaacatttttgctgaagttgctatcacatttttattcttccccatatccattcttctctcccagaggtaaccaattttataaatttgatatgtattcttccaatgtgtgtttatgttttactatatatatgtactcataaatatagaatatactgtgtgtgctatgtgtttttaaagcaactttgtgttttcaagatctcatcctgttgatacatataaatataactcattcactttaacttctaaatagcattttataagatatgacaatctacatatccattcttctattgatgggcattttggttgtttccatttttttgcattctaaaaaatgacgcagtaaagatatttgtgcatgtatccttacatatgtgtgagaatatattctgtatattgaaaagagcctagaagcaacgatagcccagaggaacaacaacaacaaaaatcctaatttctaaatatcactccacagtaaagggagtaagtgctccttaaagaaatggccaattccaagtctggagcaaaaaaatttaggtgaacctgttatatattgtgtgccagaaagcaaggaagcactcagagaattataaggatgtgtttttttaaaaaggagccagtttaaaggagctttcattagccagatctaagtttaaaaagaaaaaaaggtaaaggattataacacattaaataataataattgaaacccctaagttcatagtaattttttttttttttagacagagtctcactctgtcacccaggctggagtgcagtggcgtgatctcggctcaccaaaacttccagttcctgggtttaagtgattctcctgcctcagcctcccaagtagctgggattacaggcatgtgccatgacgcccggctaatttttttttttttttgtatttttttagtagaaacggggtttcaccgtgttggccaggctgatctcgaactcctgacctcaactgatccacccacctcagcttcccaaagtgctggattacaggtctgtgagccaccacgcctggtccatagtggtatttttttaaagtggggaggtaaatgtcttctttacagaaaaatgccaactaataaatatagaagcaatgatggaattagaaaaaccatttcaggccgggcgcggtggctcaagcctgtaatcccagcactttggaaggccgaggtgggcagatcacaaggtcaggagttcgagaccagcctggccaacatagtgaaaccctgtctctactaaaaatacaaaaaattagtcaggcatggtggtgggcacctgtaatctcacctattcgggagactgaggcaggagaatcgcttgaacccgggagacagaggttgcagccagctgagatcatgccattgcacccagccagggcaatagtgcaagactctgtctcaaaaaaaaaaaaaaaaagaaaagaaaagaaaagaaaaaccatttcaaaggtgattcatgcaaatatcattaatgaacgctaaaaacactcagtaaaaagttttgggaacggggggtcacatgctttgaaagtgttataccgctacttacttactaataaatagtaaaggggaaaattatctttacaatttgccttattttagtgaggtagagcttcttttcatgtttattggctattcaggtgtcctctgatgctcatattctttgcctattttttttttttttttctgagacagagacacagtctcactctatcgcccagcctggagtgcagcaatgcaatctcagctcacgggaacctctgccttcaggtggttcaagcgattcttgtgcctcagcctcttgagtagctgggattacaggcagacaccaacacacccagctaatttttgtatttttagtagagacagggtttcacgatgttgactaggctggtctcaaactcctgacctcaggtgatccgcctgcctcagccccccaaagtgctgcaattacaggtgtgagccaccatgcccagctctttgcctatttttctgttgacttgtttatgctttactaattgagttgtataaattcttcatatactttggacattgtaatgcaaatatctttactgagtctgtgatttatatacaggacattttgtataacaaaacctgtgatttcgatatactcaaatatctgaatctttttctttactatttgcacattttaaggcacatttaatatacctttccctattctcagtgtcataaagatagcctcctatattttcttttgaactctgaattttattcagtttgtttatccgaggagctgaacagtaagtactaaaactgttggaaaacaatattaatttttggctctaagagggtttccagctttatgtgaagtctcctttcaacaccataaataattgagagttgctatttaaaaccatacatacaaagttatagtttcaggatactaaaaaaaatagaaaagagtaaggcatataatcttacgtgagtgaacaaagcttccttccttaactcttcagaactgtcatttggagtccaagcttcagcaaactgcaggaaatcccatttttccttatcaccttcctcagcctgaattttttctttcctaccgttcagtgtgctccctgtaacttgagcctacaagaggaaaaagtaaatgaatttttgagcagttcacctcacagctgaaattcactaagtaacttgattttgcatttaaatcataagctacccactaagaaaatcttactgttccaacatatcatgggctttagtaatataattatctttgtaaaccaaaaataaaattataagcctcccaaccaacttaatggattcctcctcttggccaagagcattctaaagtaaacctgaaacacgccaggtgcagtggctcatgcctgtaatcccagtactttgggaggccaaggggggcgatcacctgaggtcaggagtttgagaccagcctgcccaacatggtgaaatcccatctctactaaaaatagaaaaattagccgggcgtggtggcaggcgcctgtgatcccagctccttgggagggtaaggcagaagaatcccttgaactcaggaggcggaggttgcagtgagctgagatcctgccaccgcactcctgtgtgacacagtgagactctgtctcaaaaaagctgaccagcattaacattaaaatagagatcttaaggctgacaaaacagactctttgtagcaacaagatgccaacatgacagatagcaggccctaaaacaaattgaaaccttttactccctaacatatttcttttgtatgaaatggctctgcagagctgtcttttgtgggaaaaatttacattctgtagagaatcccccttccattccaggtctttatcctgatccaggaaagaattaactaaggagtctggcaccttttaaagtctaataagaggccaggagcggtggctcatgcctgtaatcccagcactttgggaggctgaggtgggcggatcacaaggtcaggagttcgagaccagcctggccaataaggtaaaaccccatctctactaaaaatacaaaaaccagctgggcgtggtggcgggcgcctgtagtcccagctactcaggaggctgaggcaggagaatcgcttgaacccaggaggcagagattgcagtgagctgagatcacgccaccatactccagcctgggcgatagagcaagactccatctcttaaaaaaaaaaaaaagagtctaataagaaacatttacaatctattctgtctgaagcctgctacctggatgctttacctgcctaagaagaaccttggtctccacaactccttatcttaacccaggtattccaagtcttcagataaactctttcaaccaactgccaatcagaaaatctttgaatccacctatgatctggaaccaatgcctccctccaccccaccttgcataaaaccaagctgtagcccaaccatctaaggcacaagttctcagaatctcctggggctgtgtcatgagccactgtcattcatatttggctcagaataaatctcttaaaatattttacagtttgactcttcattgacatctagtctgttttcttttgcttataacagaatatctgaaattgtgtaatgtgtaaagaaaatgaacttatttcttatggaagctgagaagttaaggttgaggggccacatctggtgagggcttcttgctggtgggtacctgcggagttctgagacagcacaggtcatctcatggggaaggggctgagtggtgctagcttaggtctctcttcctcttcctataaagccaccagtcccactcctatgataacccattaatccctcaatccatgaatggattaatccattcataagggcagaaccctcatgacccaatcattttttttcttttttttagaagagggtgggaaagaaggtcaatcatctctcttaatggcccacctctcaatactgccacagtggggattaagtttcaaagtaagttttagagggaatgaacattcaaaccatagcaataattatccaaaattataatccattacccagtcaatggttccatgcttaatgagaaaaggtttaactggagaagttatactattcactttcttcataaaaacttttattctaatatttatatgctttgaaacttaaccaacatatgatcggccattttaaatatttatatccagtgcttaaaaaacatttcattgaaaaacagtgctatgggctgaatgtttgtatcccccccaaattcagatgttaaaatcctaactcccaatgttgatggtgttcggaggtggggcttttgggaggtgattgggtcatgagggtggagccctcatgaatgggcttagtcccctataaaagagaccccaaagagctttcttgccctctttccacaatgagaaagcagtagtcagcaacttggaagagggccctcaccagaactcaaccatactggcatcctaatctcagacttctagcctccagaagtatgagaaataaatttctgttatttataaactacccaatatagattggtactttgttatggctgcccaaacaaactaacccagaaataatctaacccttttttttttcttttgagacagagtcttgctctgtcacccaggctggagtgcaattgttgcaatggtgcgatcttagctcactgcaacctccacctcctagcttcaggcaattctcctgcctcaggctcccaagtagctgggattacaggcacctgctaccatgcccagctaatttttttgtatttttagtagagacaggggttcaccatgttggccaggctagtctcgaactcctgacctcaggtgatccacccatctcgacctcccaaagtgctgggattagaggcatgagccaccacgcccagccagaaatcatctaatccttagtcaagtcctttctataaacattgtcaagactgaggaaatgagacagctgagaggacagagcaagcaatgtcattcctacattttctagagtctgggtacaggctaccttctgtccaaaattagcttggaactcaagaattcttctagaaaaggtttattcttaggttacgcaaaggacttggggcttgaaacattacgtttccttgctagccaaccccatcattgtacctctaaagtagtagaagggcttggaagataacaggagtacgtggaagttcatgcctctcttattacagaggagagcagacaaggtactactactgaagccttttcttaacttggtctctattatcatcattatcttgatgtgcttaagtatcctttgcctgaaaacactaaaactcagcctcttaactcacattggctatggttaatagtaagtaagctgctaacttgatttaaattcaagctttaccttgcgattcaacattccccacataagggtgtctagggttccatttgcaataaggtagtgaatattcacagaactgcactggccaattctgtgagctcggtcttctgcttgttttatatgtccagggtcccagtacaactcagcaaatacaacatgacttgctgcagtaaatgttaatccctaagtgaaataaagcaaataaattgagaatgtaacatacagccaatatataataaagtatttctgaacatgttaaatggagaacactgaaggacttgaaaacaaattagttgtctattttaggccaaattaagatttaattcatgaaaggcaaatgaagaatgtttaatgcaacatagctaggtgaactacaaaaaacacatttgaaaggtatttcaaaatttcaaaagtcagcttgatgtaagtatataaactaaatcactttattctctgatgatgaacggattcacattaccactggaaaatctaataaaatactttataaatgagaatacaatttccaacatatggtatctatagcaaccaggcagagagcatttacatcctcttcatctaactcacactgtcatgttataaagcaagaaaacaacgtctctggttatactactttcttcctgtgatgttatattccgaagacctgaaatttactgcctatgtctcaatatatacaatgcaattgcattttctgtacaactgcattttcatgaatttgaaatagtgtgacataaaaatattaactaagtcttgctttataatcaatatatgaaataatgcaaaatcctcaaactaaaaaatgtgtcaaactaaaaaatgtgtccaaaaatgcatgactttaatgttggtaggctgaatgaaatgtgaaccacgcttatgctatagccatatagcagtaaaatgacattaggtggtaaacagaaatatctgcctttttttgagtattatttaatcaatgctgtttgttgttcatatgcaccaaactcctatgagtgacttttgtgactgctatgctattattttgatatgttattttcacttaaaatattttcatgtcacataacaaaatcatgctagcattaattaaatggtggtactagttctcaagctgaaaaatttactgaaaatcagtctctgaaaaagaagttagaggtaataaaaatacagagacaaatatattaaactgtactgctatttaggactgaaaatgccacagaatattagaaataatgctgaaaaaataaaaagtagtatttaaggagagacatctttaattttataaaaaacatcatttgattatacaagcataaagggaaaatatgttggcaagatcaataccactctaagcagctgctaaactataatgtaagattcacagtaccaagaacaaagacctttctactttcctttattcctatggagatatcagtcctcaagtatatgagtcttgatttatataaggtcttcagaagcacagccttgaataaaatgtaagtgccccatacattattaatttcaaaaggtcctagactctcctgtctggctttctcctacttagcacctccccagctctaagtacttcatttctaattctaagccctttttgatgatattctctgtggctggaacagtctaacagataaataactccgattattggaagtttaactgaacatgagggaagcattgagacaaccctccttttggttagaactcccagagagttgtggaactgcttcatcctcataaagtttctctctgtatataattttatatactttaattagccgagtaaaagcagatctttggcatgtaccagcttggctgaacagcagtatgctcaattacttttccctatgttaaatatcctagcttagacatttacaacaaagtattttagaatgctggcagaaaaacagtccagaagatcccctcttacctactgtggcagagactgccattactttccctaatatctatccttctcttattcctttgtaacataacacccaatttttagcagggctacgtggaataaagaatactcttccgagcttcccttgaaattaggtgtggttgtgggactaactataagagatgcagtgtgcttttctccaggcagctgcttagactgcagataagatggagctctagcagcccttttagataagacatacttgctaagagtggtaaagcagaaagcgagaaggggtataggtcctaaggactttgtgcaaacatcaggctaggcctggactgtctacataagagaattaaactttgtgtatttaagtcagtcttaatctgaatttctgtttacttgccttcaaacttaatcctaagggacaaaacagaagcactccataaaaagtcctgagacaagagttcttttcccccaggccaccttgtcatacaggtcctaatgcaacacaatcaagtaagtgaagggttggatataagacaggtataagaaaagcctatacaaattcaaaggaaggaaaaaaggtcaggcaaaaatattacaatcaaattaactatactcttcttactcttctttgaaagtatattctttcaaagacatcctttccttgaaaatttaggagatctgtgtcaaagacatcgaggcctctttctattatactttctggaactctctgaagaagaattactatttattatacaaggcatccagatacaaagttacaagtttataaaccaaagttatagtgaatggccttttttcttatttcaatgacatttcataaccaaatttagacttgaaatttcttacctggccagcagcctgaatgcttaggatagccacgcgagtgtcaggatccttttgaaactgattaaccagatgtattctttctgaagatgaaacacttccatctatcctaatgtaacgagtctagcatcaacaaggaaaacggcaaaattaggacaaggccctatgtacccatctcattttatatattttacagcttatttttatggtcacataacaaaatggaacttggttaaggtgacagattggtaaatgttatacaagaagaatcttaaccaagatttttaatagcttcttataacaatttcttatttttttaatcttttaagctacttgagggtagagtctatgtctaattcatctttatcccatcaatgccaagggcaatgccttgtatatagcagaagctccacaaatcttttatgaattaagctaatgttgtcttcagtaaaattctacgtaaattgacacgcaaactttaaaccatggatcagactaactctaaagttataagatcactaattctaaagtgaaaatacagccagacatgtgagaaaagagaaagatgattctgcccacaaatcacggattcatgaagagtagtacatttatttctgaaatatcccaaatattaactgggaaaatagagcttttttttttttttttttgtgacggagtcttgctctgtcacccaggctggagtgcagtggtgggatctctgctcactgcaagctccgcctccgggttcacgccattttcctgcctcagcctcctgagtagctgggactataggcgcccgccaccacgcccggctaattttttgtatttttagtagagacagggtttcacagtgttagccaggatggtctccatctcctgacctcgtgattcccccgcctcatcgctcccggctggaaaatagagcttttaattctggtttttcacattattaaactttaaagaaatatgtgatatggtcatctccagagaggtggggcactgaggcacccacacacatttttgaaaagtagggaaacattaagtgttaaaccgaacattgttgtctttaagaatgatttgagttgagacaagggggttatcactatgtgttagaatagctaaaaagaagttattattggccgggcgcggtgtctcacttctgcaatcccagcactttgggaggccgaggaggatggatcacgaggtcaggagatcacgaccatcctggctaacatggcgaaaccccatctctactaaaaaaatacaaaaaaattagctggacgtggtggcgggcgcctgtagtcccagatactcgggaggctgaggcagaagaatggcgtgaacccgggaggcggagcttgcagcgagtggagatctagccactgcactccagcctgggcgactgagcgagactgtctcaaaaaaaaaaaagaaaaaaaaaagaaaaaaagaaatcattattcaacttctaaaaatgataactcctaaatttcaaaaaaccttattcatgtatgtagtgccatagaaaatatagccttaaatagttggaacatatgaatattcacttttataagggaatatccaagttaattattaaaaagaatgtcccgtattaacgttctgtcctcaaagagcaagtatacattaaccagtaaaccatttaatagccattaaggaagattataaaattctctcagggtctttctaaagaaaatacattgtcagggtaggaaaagttggggaaaaattcacctccaaccccatgaatatctacatttttttttttttgagacgaagttttgctcttattgcctaggctggagtgcaatggcgggatctcagctcactgcaacctctgcctcctcctaggttcaagcgattctcctgccccagcctcccgagtagctgggattacaggcatgtgccaccacgcccggctaattcttatttttagtagagacagagtttctccatgttggtcaggctggtctcgaactcccgacctcagatgatctgcccgcctcggcctcccaaagtgctgggattacaggtgtgagccaccgcacctggcctatatctacatttttaactcttagtaaagctaaatgggattctaaacatatcagtaaaatggatgtaagaaaaaaagactattatacttggaatcgatcccagtagttttaaggtataatggaatcagaataagaaaaatattacgaatctaatttcttgcccaatcatttaaaaaatatttaggttaattaactcttagagggtgtttttcagaaactatatgataaccaatgagaaagtaccttttaatgtatagcactttattataactcttcctatgaaggaaacactagaagtatgtctttggtaatattaatgaacatattacctaatgtttaaacaatgtatactaagtttttatctttgatagaaacaaaggaagatgttgtcactcactggtggactattggaaatcaaggtagacctaagaagatgcagtaaagccacatggcttgatggagctaacctgataaattacttgggccatatgtttcaaatacatctacactaaattttagtaatcattttccatatattgcctggaagtttaaatagtatgactgcagttgggtactaacattggccaagttcattctttctttcctctctatgtcacccacattcaaaggccactgtgtaggtaaataaaaagtctaacgtttaactgtctacaccactctaaaacggtatatccaggaacaaaaataaaattcacattatagcctatcatggcagcatatctttttttttagcaacctttttttaaatttttttaatttattttttatttatttatttttagtatttattgatcattcttgggtgtttctcgcagagggggatttggcagggtcataggacaatagtggagggaaggtcagcagatgaacaagtgaacaagggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccacgcttaatccatttaaccctgagtggacacagcacatgtttcagagagcacggggttgggggtaaggttatagattaacagcattccaaggcagaagaatttttcttagtacagaacaaaatggagtctcctatgtctacttctttctacacagacacagcaacaatctgatttctctatcttttccccacatttcccccttttctattcgacaaaaccgccatcgtcatcatggcccgttctcaatgagctgttgggtacacctcccagacggggtggcggctgggcagaggggctcctcacttcccagaaggggcggccgggcagaggcgccccccacctcccggacggggcggctggccgggcgggggctgccccccacctccctcccggacggggcggctggccgggcgggggctgccccccacctccctcccagatggggtggctggccaggcgggggctgacccccacctccctcccagatggggcggctggcatggcagcatatctttaatcaatccagataatttggtcagtggaaaattatgagatcagttaagaaaagagaaaatttaatagtatataatcatcatcatataatattaatataattttcaagaaaaatgtgtgataatttatataccatcatctaaagaagacaaaaaacacctcaactatgagactacaactgatgtttagtatagtaaaaatatgcattctaaaaagtatttagttaaaaaatggcaacataccttattttcgatgactgcttctgtgcaagcttggagcatgcttaaatggtgagcaaaaaccagaaatttaagcgaatcattctgaagcatcatcttaatataatcctttacagcacctgcctaaatattaaaaggtaaaccttattagtgtcataaaaatgattatttaaaatttatgtcacttttaataaagcaagaaaaatggcttgaaaatcagtaaatatgaacttttagctgcattgttctctaggtagcctaaggaagtagaagcccacatataaggaaaatgtaaaagaagagggacaagaaggggaaaaactgagcaattaaatgagaagaagacaagaattagaagaattaaaaaacaacacaacaatgggtttcaatggaaaggaggtagtcaagtaggctatggccaagaaggagttggcagttttgtttagaaggtgattttcaaaaaagtttatatataagaccaagtagaacagagttaaggagaaaacagaaagcaaaaaaatcagatgaagagcatttttttttaaaagggaagattgaaaacagtaagaaatcagggactgaagcttaaggtttaaggaaagtttttttttttttttttttacttaagaaacttaggtagacttacaaataagcagttcaaggagtacacagattaagagaaatggaaatgaggtcatttagcttatctctgggatggagaaggttccagaagaggctggagtgatgggatgaagacaacggtagtgaggtctgagagaacagggggacatatagaacaattatgacacagaaggaagaaaatttaaaaagttcagattaacaggtaacttgaggccaagttacttactaagagtgaaaaatcaatttgatatgaagcaaatacgaattaaagaggatagcatgaattaagtttaaaatctatgtatcttttaacttttaaaaactggttatgtagaaattgtggaaaaagataccaggctgaccacatttaacttctgctccttctcaatgctatgtttaaaagatagcaagtgtaaagggacaaagagaactggagaaaagtcaatagcaacaaaactttggaagctaaaaagcagataatgactgataactgattaaccaatctcacagatcctaaactggctatggaaagtggagaagcacttgatttacgttgcagtcacctaaaaaggttcagaaaatgacacctctggaatggggggtaggagtgtggttaggaggacctgctgaaataatgtttaagtagttgattatgtgcaatactgctatttaccttctctctacctattccatataataggtaactaccataaccattctggtagaaaactacagacttattctctggagtggataaaatagagggtatttggatggaggaatcctatattgatgataggtatatcctacaaaactcatggggattacatgaaagttacaaaataaatgctgagatctgcccctctgtcccagccttctttcccctatacttcccaaaacagaaacaggcttatgtccttcaggcaagagagcagaatcatataaagtgattcttttctaaggaatctgaccagccaagagaaaaaactaaagatactgctatcaggggtttcccagggagacatcccattcagatcaccatttattgaaggccacagtctataaattgtatacatgcgcagagcttctagtcagtggttagtgtctttcttgtaaatataagcaaccaaccaaagatcaatagatatttgtagaaagcaacatgtatgaacggatcacatatacagagctaagaaaactggaagagattgcatttataaaacaagatcagtatgctacaaaaaaaacagatataaagaagaaaaacagtactatcagaaatgaaaaatataatagcagaaatggataattcattggttattaagctaaggaaatctcccagaaagtaaacagaaaatataaaatataggccaggtgcgggggctcacgcctgtaatccaagcactttgggaagccaaggcgggcagatcacttaaggtcaggagttcaagaacagcctggccaacacggtgaaaccccgtctctactaaaaatacaaaaattagctgggtgtggtagcacgtgcctgtaatcccagctacttgggaggctgaggcaggagaatcgcttgaacctgggaggtggaggttgcagtgagccgagattacaccactgctctccagcctgggcaacagtgagactctgtctcaaaaaaaaaacaaaaaaaaaaaacaaatataaaatgtaaaataattaggtaggggatcaggtcatgagggcaatatatgaaaatatatgaataataaaagtctcagaaaacaaacagagaaaactaacaaaaatcatcaaagaaataaagttctacataactgaagggcatgagtttccaaaatgaaaaatggaaaagacccactacgtgtctttcacattgaatgaaaatagacccagaacgaggctcattatcaagaaattttagaacactgggacaaagaaatgattctataagcttccagaaaagcgaagaaaagatttcatagaatcaaaatagaataacaattctgaattgtattggatttctcaataccaataccagaaatgagagaaaatgatttccccatttttatatccagctaattaaaaatcagatagaatagtaatattttcaaatatgcaaggaatgcaaataatttgcttccaatataccatttcttgggaggctactggacaaaatgctccaacaaaacaaggaagtaaacaaagaaagaaaataatatataaaggaaagaggtaaaaatctccaggatgagagctctgcagcaggcctaaagagtaacagttcagactggagctaatcagaaggaatcaggtgaaatttctttaagaagatgagattaatacaatgcttaatgtttaaagatattgggaggaggttaaataactaggggaaactttgaggatggattagtgacaactacacagaaaactaataaaagaagaaaagaaaaacctttataattattaatgccaaagaaaataaaatgagttgtggaagaaaacgtatccatagcataccatgtttcacctgtaaatgttataaatatggttctaataataaacatggtgaatactgatcaagccaaaattggtaataagttcctatataatcagtaaaactatgattatgactttcatggaaggatggaaataacaggaagatatgtgtgtgagagtggggcaataggggacagggctaaaatttaatcttccgtattaagaagccaattgatgacagctaaaattacaaagcaaatagtaatacaaacaaagcagcaatataagtatggtgttgagggatttgaagtaaatactaaaaaaaaaatcagctgaaagaaaagaaggttgttgcctttgagaaataaggttaggggactgttattttttggatctctggtcattaaactatgatactatgtagctttggcaataataaaaaattaaaaaggaggcatttcaaaactgaaaaatacctacttaaaattcatacatatgactataaagtcacatgacagattctgcaaactacattttgcatgtctaagttttctaaaccacagaaattcatcatacaatgagagtaggggctgttaagaactttagccttggatttcagtgccttggaaagtggaagtgaagtactgtcaaaataaggagctataaattctggatatgttgtcatggcaactgaaccactttaataaagtgcatatttgcctaaagagctatatttactgtgataagcctttcaaaatgtacatgtcaagatggagtacttttaaggtacattcattactatccagtccagacttacaaactatataattgctaaacctctagtctcggatggattccccctcctcttcccaagtgagcaatttttcttagagtctcctccactgatatcacctgcttccatcacaaccagagatgccaatgccaaagttcaagccccccttttcccactcctttccactagtgcttcaaaaaggtttacggttactaacattattataaagttcaattacataactgactaaataggctcttaggactaacaaagcaatttaaccatcatttgtgatattgctttttaggagaaaatgtgttgggaataccaaaacatcaaaagtaacaaatgaacttttgggattctcttaggttcttaagatggggattacatagattttcattttaaaatgtactatgcatgcattttaactattttgattttatcctaataaaaactatcactgcatcatcagattttaaattatctgaacaggaatttgcttccaaacgatcttaagtacatagtatgtggaatagcaggtcctcataataatcagcatcttggtagtgtcggttcaggtttcacagaagttgcagaaaatgcatgtattcaaaactctattttattttactagaattgatctgttagtaataagcctgttagtcgaagatctaatttaagtaattaatgaagactatacattatatcttatttaaaaaaatgcaggccaggcgtgggggctcatgcctgtaatcccagcactttgggaggccaaggtgggtggatcacctgaggtcaggagttcgagaccagcttgaccaacacggagaaaccccatctctactaaaaatacaaaattagccgggtgtgatggcacatgcctgtggtcccagctactcgggaggctgaggcaggagaatcatttgagcccgggaggcagaggttgcggtgagctgagatcacaccattgcactccagcctgggcaacaagagtaaaactatctcaaaaaataaataaataaattaaataaaatacaacaatgaagagaatattcatgatttttttttcagtgaagatgtacacatcttactttctgaagtaaaagtagttaaagaaaaatctgtattgcactaaagacctgttaaaagttatttgatttcaaattgttggcttttaaacaaataataagaaagaaaaaaaagaaagacaaaaacttcaaacctgagctatgacaaagactctcctttgacctaactttagttaggctcccctgagccctctttgcaactaagccctcaccttggccttcagtgtccatcctgtccttgccaggcctgcatagcccagtcttataggaaccccactaagtcatttcagtgaaaatccccccactcttgatattggatctagttccttattccgtacctttgatgtataaacccttggcctgtctttagcaagaatccccttacccttgatgtctcctcttagtaattttccattcatcaactctctcaacctacttgctggctataaatctctacttgtccttgtgtttggaattgagctcaacctctctcgtctattgcaaaagagttgacctctactgcaatagtcttgagtagtcttccctactgttttaacaagtcagaataatcttttctttaacagctataacttgcagctaagagagtgtgagcacaaaggaagcttccctttaagtcctgaagtcctcagaacccaatcaaatgatagttttgttcaggtatcgcatgaccttttaagctctttttttttttaaagctcttttaatgtcttcttagtcacaggtaaattgtgattggtctaagcaaacctagcattttcctttcccctgcaaatgattctgactaatatgacacctgaggagtctgctgggggtttcaaaaaaacatcctccctgacaaaggcactcttaggaacacttttccttgctttggacattataggctgcacttgatatctgatatcccggaatgcagcagtcatcttggggctataataggagctgttgagggcaagcagtgaactgggtcagacaacagaagacagaagaacctgggttctctctcttttttaaaaaatagcttcactgggatacaattcacataccataaaattcactcttttaaagtgtacaattcaatggcttttagtacatttgcagaattgtgtatcatcacaaaaatcacaacctaacaatgttaggaccttttcattaccctaaaaaggattcctttacctctcagctgtcacaccccagttgcccatcatttcagctctaggtaaacattaattaactttctgtctctatggatttgactcttttggacgttccatataaatggaatcatataatatgtgttttctgagacagcttctttaacttagtgtaatggtttccaatccatgttgtagcatacatcagcacttcatttcttttttaatgtcaaataatattccattgtatgaatatatatgcattttatttacccatcagttgatatactctcttatttttattcatttatctagctcaccttatactgttccttaataacttatttattttgtgatagttgatttacttactatcctttaaaattatcttaaataagcagagccaagtaccaaagtaaaggagaatatgcattgtttatttactccccacctagcttctgcagctcaccacaaaaggaaggctagacattgtcttccggtatcccttccccctttgccaatagtttttaatttagaaactttttcattagcctgaaaaaacattttcaaatctgttagtaaacatttccaaatctggtaggagacagccttcaggagaagactggcagtttccataccataatgtcagggctttgaacatttttacagagcctcatgcccaaattttcccaaagaaacactagtttcacttcaaaagatggttccagtgaactatcaaaagtattattttcttatctcaaggagtattttacttccttataaatatatctgcaaatacaaatctaatacctctaatacatttaatcttttgacactgatggagttccacaagcagcatgctgaaaagtagatgggatacaataccttgtgaagaaggcaattccaatttaatatcttaaccagcatagttttacaaaaaaaccctgggatcctaaatctttccataaggttttcagaacaagttataataaggcaatcattatcaatcaatctatcaatttggcaaggatacatgagaacattcctgtgaatgacctaattccatttacccaaaatttacccaaattttgacaaagtaaagccaatagtattatgagctttaaaaaagttattttcatggaggtttgatcataaaagtcactgatcaaaacagctaatctaggccagacacagcgacacatgtttataatcccagcactttgggaggctggggcaggaggactgctcaagcccaggagtttgagacaagactgggcaacatagtgggtgcctgtatctacaaaaaatttaaaaattagccgggtgtggtggcatgtgcctatattcccagctacttgggaggctggggcagaaggattgcttgagcctgggaggttgaggctgcagtgagctgtgattgtgccactgcactccagcctgggtgacagagtgagaccctgtctcaaacaaacaaaacagctaatctaattcttttaaaactgaattcaggccaggcacggtggctcacgcctgtaatcccagcactttgggaggctgaggcaggtggatcacgaggtcaggagatcgagaccatcctggctaacatggtgaaaccccatctctactaaaatacaaaaaaactagctgggcgtggtgatgcacacctgtagtcccagctagttgggaggctgaggcaggggaatcacttgaagccgggaggtagaggttacaggttgcagtgaaccaagatcatgccactgcactccagcctggtgacagagcgagactctgtctaaaaaaaaaaaaaaaactgaattcaatttttaaaaacattcttgatttatttctaaactccatccactagtcatgacaataagataatcaactttgtcctactaaagtacagaatacaccttatttgggtgttaaaaatcaaaatacacagaatgtacagactttaaagtctgtatcttttccatgcctatttagggatgttgaaaaatcactaataggaagccaggcatgatggctcatgcctgtagtcccagctagtcaggaggctgtggtgggaggactgcttgagcccggaagttagaggatgcagtgagccatgatcacaccactgcactccagcctgggcaacaagagcgagaccctgacccttaaaaaaaatcactaatagaaaaacaggtaacacattaatccatggtcactaacaaatattatgtctattaagctatctttgttgaatgatggctaagcacatggactgtggagccagacagtctgggtttgaatcctagctccatcacttacaatgtgagagacattgagaaagtcacttaatctctgtgctttaattttctcatctataaaataagataaaagtacctacaccgcatagggttgtggtgaaaattaaataagttagtccatgaaatatgcttggattagtgattggcacatagtgaacattataaaagtattagctcttattattagcatatttctccagtaaaatgcaaaaactatttcaacctcttccacttcctttgaaatcataacctatgactcctggctttcaaaccaccccttgcccaaagaaaacagaatcacatctgagaattctgttacctttccttgtttgttttgtttgtttgtttgcttttgagacggagtctcgctctgtcgcccaggctggagtgcagtggcgcgatctcagctcactgcaagctccgcctcccgggttcacgccattctcctgcctcagcctcctgagtagctgggactacaggcgcctgtcaccacgcccggctaattttttgtatttttagtagaaacggggtttcatcatgttggccaggatagtctcgatctcttgacctcgtgatccacccaccgcggcctcccaaagtgctgggattacaggcgtgagccgccgcacccggccacctttccttactttactcatcctcacttcctttccttttgtaacaagagaggttatttcttctttttttcttttcttttctttttttttttgagacagagttttgctcttgttgcctaggctggagtgccacggtgcactcttggctcgctgcaatctctgcctcctgggttcaagcaattctcctgcctcagccacctgagcagctgggattacaggcatgcaacaccacgcctggctaattttgtatttttagtagaaacggggtttctccatgttggtcaggctggtctcgaactcccggcctcaggtgatccacccgccttggcctcccaaagtgctgggattacaggcatgagccaccgcgcctggcaaagaggttatttcttctttttctatggtaaactcctctatttgtgattccaacctacccattcttgccacctcaaaaaccttacaacactcaagtggattatttccttatctttaataaagccttcctccatgccacatctccatatagttaatatactctttcatcctctaaaatggtaacattattattttatttgcactgtattgattattgctgactttcctgctaatgaagaggaggcagagtgtccccaattcagagccagagatcctttccgaaactacagaactggcacaagaagaagcactcttcagtctcatatcttcccagaccctgtgcagcagggaatattgcagtggcctcattatacctcactgaatattataaataggattccacctgtgctaagctgctgaggcaattaaagaggaaacacactttgtgcataaggaaaacgtgtttaaagtaatttgccttctggaaagttgttaaggcacgaaggaatgctgccatccctctagagataagaaattttaaattatgggttggctttaatccttttcatagaaaaataactggcatttctcccaaaatggtttcttctaaaaataaggcattgttttgatgtgcctgttgtaatgtacttgaattgagagatggctagaccatatgtaacacatgtaactgttttttttctaggagaatattatgctgatcacaaatctgaagaatttgtttattttcatccattgtattctcaacatacattacaaagcaacaaaaataatgatatagaagaaaagtaattgtcctaattatcagagattctccaatagttgactttgtactggtaacattgattatttttggttcattcctttactatttatcatcattattttaaaaaatgttccattgttttattatttatttttattttattaggtttttgggggaacaggtggtgtttggttacatggatatgttctttaggtgtgatttctgagattatggtgcacccatcacctgggcagtgtacactgcatccaatgtgtagtcttttatcccttacacccctctcaccctttccccaagttcccaaagtcccattgtatcattcttacgcctttccattttctttttctttttgagagggagtctggctttgccacccaggctggagtgcagtggtacaatctcggctcacaacaacctccacatcccaggttcacgcaattctccttcctcaacctcccaggtatctgggactacaggcacacaccactacacccggctaatttttgtatttttggtagtgacggggtttcaccatgttggccagactggtctcaaactcctggcctcaagtgatctgcctgccttggcctcctaaaagtgttgggattacaggcgtgagccactgcactcggccttattttttgatttttaaatgatagccattcttacaggaataaggtggtatcgcactgtggttttaatttgcatttccctgataatacgtgatgatgagcattttttcattttttttggccatttgcatatcttcttttgagaattgtctattcatgtccttagcccactttttgatgggattattattattatttttttcttgctgacttgtttgagttccttgtagattctggctattagtcctttgttggaggcatagtttgtgaagattttctcccactctgtgggttgtctgtttactctgctgactgctccttttgctgtgcagaagcttttacatttatttaagtctcatctatttatctttgtttttgttgcatttgcttttgggttcttggtcatgaactctttgcctaggccaatatctagaaggggttgtccaatgttatcctctagaatttttatggttttaggtcagatttaagtgtttgatccatcttgagttgatttatgcataaggtgagagatgaggatccagtttcattcttctacatgtggcttgccaattatcccagcaccatttattgaatagagtgttctttccccactttatctttctgtttgctttgttgaagatcagttggctgtaaatatttggctttatttctgggttctctattctgtaccattagtctatgtgcccatttttatacaagtaccatgctgttttggtgactataaccttacagtacagttcaaagtcatgtaatgtgatacccctggatttgttcttttttgcttagtcttgctttggctatgatgagtcttttttggttccatatgaattttaggattgttttttctacttctgtgaagaatgatgatggttattttgatgggaattgcattgaatttgttgattgcttttggccatatggttattttcacaatattgattctaccaatccatgagcatgggatgtgttgacgtgtttccatttgttagtgtcgtctgtgatttccttcagcagtgttttgtagttttcctcgtagaggtctttcaggtccttggttaggtatatttctttccttttttttttttttttttgcagctattataaaagagcttgagttcttgacttgattcttggcttggtcactgttagtgtatagcaatgttactgatttgtgtacatcgattttgtatcctgaaactttactgaattcatttatcagatctaggagctctctggatgagtctttagggttttctgggtatacgatcttatcattggcaaaccatgacagtttgactttctctttgctgacatggatgccctttatttctttctcttgtctgactgctctggctaggactttcagtactatgttgaatagaagtggtgaagtgggcatccttgccttgttccagttctcaggggggaatgctttcaacttttccccatttggtataatgttcgctgtgggtttgtcatagatggcttttattaccttaaaatatgtcccctctatgatgatttgctgagggttttaatcacaaaaggatgctggattttgtcaaatgccttttctgcatctattgagatgatcatgtaatttttgtttttaattctatttaggtggtgtatcacatttattggcttgtgtgtgttaagctatcccagcatccctaatatgaaacccacttgatcatggtggattatctttttgatatactgttggatttggttagctagtattttgttgaggatttttgcatctgtgttcattagaaatattggtctgtagttttcattttttgttatatcctttcctggttttggtgttagggtgatactgccttcatataatgatttagggaggattcccactttatctttcggaacagtttcaatagaattggtaccaattcagttgtgaatccatctggtcctgaactttcttttgttggcaatttttaaattaccatttcaatcttgctgcttgttattggtctgttcagagtctctatttcttcctggtttaatctaggagtgttgtatatttccaggaatttatccatgtcttctaggttttctagtttgtgcacataaaggtgttaacagcagccttaaataatcttttgtatttctgtggtattggttgtagtatctcctttttcatttctaattgagcctacttggatcttctctcttcttttcttggttagcctcactaatagtctatcaactttgtttatatttttaaagaacttgtttctgcttcatttatcgtgtgtgtgtgtgtgtgtgtgtgtgtgtgtgtgtgttgtttcaatttcatttacttctgctctgacttttgttatttcttttcttctgctgggtttgggtctggtttgttcttgtttctctagtttcttgaggtatgaccttagattgtcttattagtgctctttcacagtttttgatgccggcatttaatgctatgatctttcctcttagcactgtttttgctgtatcctagaggttttgatgggctgtgtcactattatcattcagttcaaagaatctataaatttcaatcttgattttattgttgactcagtgatcattcaggaacagactatttaattttcatgtatttgcatggttttgagggttcttttgtagttgatttctttttttgtttttaagacggagtctcactctgtcgccaaggctggagtgtagtggcgtgatctcggctcactgcagcctctgccgcccaggttcaagtgattctcctgcctcagcctcccaagcagctgggattataggtgcctgccactgcgcacggctaatttttgcagttttagtagcgacggggtttcaccatgttggccaggccggtcttgaactcctgaacttgtgatctacccccctcagcctcccacagtgctgggattactggcgtgagccactgtgcccggccatggagttgatttataatttcattccactgtggtctgagagagtacttgatacaatgtgatttttttggctgggctcagtggctcaagcctgtaatcctagcatttcgggaggcaaagtcaggtggatcacttgaggaccaaagttcaagatcagcctagccaatatagtgagaccccatctctactaaaaatacaaaaattagctgggagtggtggcgcatgcctgtaatctcagctacatgggaggctgaggcaggagaattgcttgaacccaggaggcagaggttgtggtgagtcaagactctgccactgcactccagtgtgggtgacaaagtgagaccctgtctcaaaaacaaaaacaaaaacattcgattttctgaaatttattaaggcttgttttgtggcccatcatatggtctaccttagagaatgttccatgtgctgatgaatataatgtatattctgtagttgttgggtagaatgttctctaaatatctgttaagtccatttgttctagggtacaactgcagaatgttatgtacatatctgttatgtccatttattctagggtatagtttcagtccattgattctttgttgactttctgtctttatgacctgtctagtgctgtcagtggagtaatgaagttcccctatattgtgttgtggtctatctaacttcttaggtatagtagtaattgtttcaaaagtttgggagctgcagtgttaggtgcatacatatttaggattgtggtatcttcctgttggactagtcctttcatcattatataatgtccctgtttgtctcttttaactgttgttgctttaaagtctgtttttttctgatacaaggatagctactcctgctcacttttggtgtccatttacatggactatctttttgcaccgctttaccttaagtttatgtgaatccttatgtgttaggtgagtctcctgaagacagcagatacttggttgatgaattcttattcattctgccaatctgtaacatttaagcgcagcatttaggccatttacagtcaacgtcagtattgagatgtgaggtactattctattaattgtgctagttgttgcctgaataccttgggctccccccctccacccccaccccattgtgtcattgttttacaggccctgtgagatttatgctttaaggaggttctgttttggtgtatttcaaggatttgtttcaagatctagtttcatgatctttttgcgatgaatttcctgggtgttctttgagcttcttgtatttggatgtctagatctctagcaaggccagggatggtttccttgattattccccgaaataagttttccaaacttttagacttttcttcttcctagggaacaccaattattctggcacccaggctggagtgcagtggtatgttcttggctcactgcaacctctgcctcccagagaggcaagccattctcatacctcagcctcctttttgtatttttactagagatggggtttcaccatgctggccaggttgctcttgaactcgtgacctcaggtgatccacctgtctcggcctcccaaagtgctgggaatacaggcgtgagccactgcgcctggcccgggaacaccaattattcttaattcttttttttttgagacagagtctcactctgtcacccagggtggagtgagtgcagtggcatgatcttggctcaaggcaacctctgccttctagattcaagcgattctccagcctcagcatcccaagtagctagtattactggcgtgtgccaccacacctagctaatttttgtatttttagtagatacggggtttcaacatgttggccaggctggtcttgaactcctgacctcaagtgatccagccccctcggcctcccaaagtgctgggattataggcatgagtcacagcacctggccattcttaattattcttaggtttggttgtttaacgtaatccccaacttcttggaggctatgttcatttttaaaaattctttttattttttatttttattttattttatttttttaattttattattattatactttaagttttagggtacatgtgcacaacatacaggtttgttacatatgtacacatgtgccatgttggtgtgctgcacccattaactcgtcatttaacattaggtgtatctcctaatgctatccctccccccttcccccaccccacaacaggccccagtgtgtgatgttccccttcctgtgtccatgtgttctcattcttcaattcccacctatgagtgagaacatgcggtgtttggttttttctccttgcgatagtttgctgagaatgatggtttccagcttcatccatgtccctacaaaggacatgaactcatcattttttagggctgcatagtattccatggtgtatatgtgccacattttcttaatccagtctatcattgttggacatttgggttggttccaagtctttgctattgtgaatagtgccgaaataaatgtacgtgtgcatgtgtctttatagcagcatgtttgataatcctttgggtatatacccagtaatgggatggctgggtcaaatggtattcccagttctagatccctgaggaatcaccacactgacttccacaatggttgaactagtttacagtcccaccaacagtgtaaaagtgttcctatttctccacatcctctccagcacctgttgtttcctgacattttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgttttttcttgtaaatttgtttgagtgcattgtagatgctggatattagccctttgtcagatgagtagactgcaaaaaatttctcccattctgtaggttgcctgttcactctgatggtagtttcttttgccgtgcagaagctctttagtttaattagatcccatttgacaattttggcttttgttgccattgcttttggtgttttagacatgaagtccttgcccatgcctatgtcttaatggtattgcctaggttttcttctaggggttttatggttttaggtctaacatttaagtctttaatccatcttgaattaatttttgtataaggtgtaaggaagggacccacttccagctttctacatatggctagccagttttcccagcaccatttattaaatagggaatcctttccccattgcttgtttttctcaggtttgtcaaagatcagatagctgtagatatgcggcattatttctgagggctctgttctgtcccattggtctatatctctgttttggtaccagtaccatgctgttttggttactgtagccttgtagtatagcttgaagtcaggtagtgtgatgcctccagctttgttcttttggcttaggattgacttggcaatgtgggttcttttttggttccatatgaactttaaagtagttttttccaattctgtgaagaaagtcattagtagcttgatggggatggcattgaatctataaattaccttgggcagtatggccattttcatgacattgattcttcctacccatgagcatggaatgttcttccatttgtttgtatcctcttttatttcattgagcagtggtttgtagttctccttgaagaggtccttcacttcctttctaagttggattcctaggtattttactctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacgatggggttttctagatatacaatcatgtcatctgcaaacagggacaatttgacttcctcttttcctaattgaatgccctttatttccttctcctgcctcattgccctggccagaacttccaacactatgttgaataggagtggtgagacagggcatccctgtcttgtgccagttttcaaagggaatgcttccagtttttgtccattcagtatgatattggttgtgggtttgtcatagatagctcttattattttgagataaatcccatcaatacctaatttattgagagtgtttagcatgaagggttgttgaattttgtcaaaggccttttctgcatctattgagataatcatgtggtttttgtctttggttctgtttatatgctggattacgtttattgattttcgtatgttgaaccagccttgcttcccagggatgaagcccacttgatcatggtggataagctttttgatgtgctgctggattcggtttgccagtattttattgaggatttttgcatcagtgttcatcaagcatattggtttaaaattctcatttcttttgtgtctctgccaggctttggtatcaggatgatgctggcctcataagatgagttagggaggattccctctttttctattgattggaatagtttcagaaggaatggtaccagctcttccttgtacctctcatagaatttggatatgaatccatctggtcctggactttttttggttggtaagctattaattattgcctcaatttcagagcctgttattggtctattcagggattcaacttcttcctggtttagtcttgggagggtgtatgtgttgaggaatttatccatttcttctagattttctagtttatttgcatagaggtgtttatagtattctctgatggtggtttgtatttctgtgggatcggcggtgatatcccctttgtcattttttattgagtctatttgattcttctctcttttcttctttattagtcttgctagcagtctatcaatttttttgatattttcaaaaaaccagctcctggattcattgatttttttgaagggttttttgtgtctctatttccttcagtactactctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagactttggtatgttgtgtctttgttctcgttggtttcaaagaacacctttacttctgccttcatttcattatgtacccaatactcattcaggagcaggttgttcagtttccacgtagttgagcagttttgagtgagtttcttaatcctgagttttagtttgattgcagtgtggtctgagagagagtttgttataatttctgttcttttacatttgctgaggagtgctttacttctaactatgtggttaattttgggataggtgtggtgtggtgctgaaaagaatgtatattctgttgatttggggtggagagttctgtagatgtctattaggtccacttggtgcagagctggggttaactttctgtcgcgtttatctgtctaatgttgatagtggggtgttaaagtctcccattattattgtgtgggagtctaagtctctttgtaggtcactaaggacttgctttatgaatctgggtgctcctgtattggatgcatatatatttaggatagttagctcttcttgttgaattgatccctttaccattacataatggccttctttgtctcttttgatctttgttggtttaaagtctgttttatcagagactaggattgcaacccctgcctttttttgttttccatttgcttggtagatcttcctccatccttttattttgagcctgtgtgtgtctctgcacatgagatgggtttcctgaatacagcacactaatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcgatggtctttacaatttggcatgtttttgcagtggcttgtactggtttttcctttccatgtttagtgcttccttcaggagctctggtagggcaggtctggtggtgacaaaatctctcagcatttgcttgtctgtaaaggattttatttctccttcacttatgaagctcagtttggctggatatgaaattctgggttgaaaattcttttctttaagaatgttgaatattggcccccactctcttctggcttgtacagtttctgctgaaagatctgctgttagtctgatgggcttccctttgtgagtaacccgacctttctctctggctgcccttaacattttttccttcatttcaactttggtgaatctgacaattgtgtatcttggagttgctgttctcgaggagcatctttgtggcgttctctgtatttcctgaatttgaatgttggcctgccttgctagattggggaagttctcctggataatatcctgcagagtgttttccaacttggttccattctccccgtcactttcaggtataccaatcagacgtagatttggtcttttcacatagtcccatatttgttggaggctttgttcatttctttttattcttttttctctaaacttttcttcttgcttcatttcattcatttgatcttccatcgctgatacactttcttccaattgatcgcatcggctactgaggcttgtgccttcgtcatgcagctctcgtgccatggttttcagctccatcaggtcctttaagtacttttgtgcattggttattctagttagccattcgtctaattttttttttcaaggtttttaacttctttgccattggctcgaacttcctcctttagctctgagtagtttgatcttctgaagccttcttctctcaactcgtcaaagtcgttctccatccagctttgttctgttgctggtgaggagctgcgttcctttggaggaggagaggcgctctgatttttagtgtttctggtttttctgctgtttttccccatttttgtggttttatctacctttggtctttgatgaaggtgacatacagatgggtttttggtgtggatgccctttctgtttgttagttttccttctaacagtcaggaccgtcagctgcaggtctgttggagattgctggaggtccactccagaccctgttttcctgggtatcagcagcggtggctgcagaacaacagatattggtgaaccgcaaatgctgctgcctgatcgttcctctggaagttttgtctcagaggagtaccctgccatgtgaggtgtcagtccgcccctactgggggctgcctcccagttaggctactcgggggtcagggacccacttgaggaggcagtctgcccattctcagatctcaagttgtgtgctgggagaaccactactctcttcaaagctgtcagacagggacatttaagtctgcagtggttactgctgccttttgtttgtcttagccctgccctcagaggtggagcctacagaggcaggcaggcctccttgagctgtggtgggctccaccgagttcgagcttcccggccactttgtttacctactgaagccttggcaatggggggcacccctcccccagcctcgctgccaccttgcagtttgatctcagactgctgtgctagcaatgagcaaggctcagtgggcatatgaccctccgagacaggtgcgggatataatctcctagtgtgccgtttgtgaagcccattggaaaagcgcagtattagggtgggagtgacccaattttccaggtgccgtctgtcacccgttcctttgactaggaaagggaattccctgaccccttgcgcttcacgggtgaggcgatgcctcgccctgctttggctcatgcaccgtgcgctgcacccactgtcctgcacccactctccagcactacccagtgagatgaacccggtacctcagttggaaatgcagaaatcacccgtcgtctgcatcgctcacgctgggagctgtagactggagctgttcctattcagccatcctaaaaattcttttttctttgtctttgtcagattgcattaatttgaaagccttgtcttcgatctctgaagttctttattctacttgttcaattatattgttgtaagtttacagtgtattatatatttctctaagtgtttcttttatttccagaagttatgattgtcttttctttacgatatctatttctctggagacttttttgtccatatcctgtattgtttttaaaatttattggctgggcttggtagctcacgcctgtaatcccagccctttacagagctgaggtgggtggataacctgacgtcaggagttaatatcagcctggccaacatggtgaaaccctatgtctactaaaaatacaaaaattagctgggtgtggtggtgcacacctgttgtcctagctactggggaggctgaggcatgataattgcttgaacccgggaggcagagggtgcagtgagccaagatcgtaccactgcactccagcctgggtgacagagtgaaactctgtctcaaaaacaacaaaatattatgtaagttggtttttacctttctctgatgcctccttgagtagcttaataattgacctctgaattctttttctggcacttcagatttcttcttggttttgatccattgctggtgagctagtgtgatcttttggggatgttaaagaaccttgctttgtcatattaccagaattgtttttctggttccttctcatttgggtagaccatgtcagaggaaagatctggggctcaagggttgctgttcagattcttctgtctcagagggtgatcccctgatgtggtgctcgcccccttcccctaaagatgggccttcctgagagctggactgcagtgattgttattgctcttatgggtctagccaccccagtagagctactggcctctgggctggtactgggaagtgtctgcaaagagtcctgtgatgtgatcagtcttcaggtctctcagctgtgcatactatcaccagctctgctgaagatagtagggcagtgaaatggactctgtgagggtccttggttgtagttttgtttagtgcactggttttcttgaatgctggttgtgctagcagtgaatttgtcacatgtacagactgaggatctcaggttagccaggatgttacaggcagtgggattacctgttgtttcctccttttttggagcacggttgttctgagtcgctgtaatggcttgagttggctggcctccagccaggagggggtgctttcaagagaacatcagctgcagcagtatagggggcatacaagcttgtctaaagtccctggacaagtattccactttctcgggcgatggacaggactatatagattctaagagattatgtcttttgtcttctcttaccagggagggtagagaagaccatcaggtcgcagggttagttgtgtctgagctcagactctccttgggctgggactgctgcatccactgtgggggcttggagtgtggttctcaggctaatggacttatgttcctagggagattatggttgcctctgctgtgtcatacaggtctccagggaagtgggggaaagcctgcagtgacaggccttatccagctcccaggcagccagcaaggccagtctcactcccactgtgctccacggaaagcactgagtttacatccaggcagctcttgccccaggctacaagcctcccctgctctgcctatagcttcttctgtgcttgtatctgcacttcccattctccttgagcaccatccccctccccaggtttttgtccaggaaaatttgcactaggtcgaaattattagagttcagctggaagtttccttctccttgtggccctttcccagttccactggaagccctccctatcgtcattatttactatttatcattaccattatttgttttctttaagaactatctgaaaaagagaccttgataatctaataacaccactaaggagataacaaacatacttaaaatatactttgtcctcctaagaagtacttcaaaaggcagactagcataaatgtttatatagcacataaataatatatgccaataccataattctgtagcatagcgttgtacatattaaaatttattaacaatatgacctaatttgctgacatgacctaatttgaagccctgtactatcctattgtctgcctagaacagtgtgtaagttatgaagcaaagaaaagattacagcagagaaagaaatcttttatcttgaagatctataaaattaggatggatagagacccatttgtttggaaggctttaggcataactctgtctagagcaaaggaagaggaaagatgactcaatactctctaggcccaatgctctctaaccacaattagtgaacagtgttaaaaaaaagaatagagaaagtattcacttcctcagtttgacaagaacaagatttcatactgcatacatttatgtatttattatggaattatagcctttgaaaaactaaacaccacaaataatgaggaattcattttactataagtaataattaagtatatgcccttaaaatagcatatcctataagtagctgcatatttgcacccatctatttacttgaaaactcattattctctttaaatttttccttcttattcttatgaagattttaaaaaaaccatcatcaggtggctttaaattatcttcaaattcctcaacataatttttcaaatgattcattgaaaacaaaagtatttctaaaatgatgctacagagtacaaagaaaatttctactatctaacagcttgcaccttgttgtgtttggcacagattatgcttaatgggggtctgggcacaaaatatatctcctattttttcacaattttaatgaatggcagaaatatcaacccagttgaccaagcaagaaatctagatttgaccttttccctcccttccacattcagtcaatcaccaatgtctactgattgcactgccttaatctatcatgaattattcctttcccagttaagatatgatacagccactacattggtttagatcaccagcattgttcatctagattatcagtgagcatcctaagtggattctctgcctattagttattgcttccaatacattctccacacagctagttattcctctaaagcccaaatctgattattgtactccaatccactgtacctgactgctaagaacctttagaataaattacaaactatgaactgtgactttcataatgtagttatagctctcattgacctccagcctagtctcagtcagaattcctcttctttttgagaagaggaattcctcctcttcttcctctgtcacccaggctagaatgcagtggcacgatcgtggctcactgcagccttgaccttctgggctcaagtgatccttccacctcagcctctcaagtagctgggagtacaggcacatgccaccatgcccaattaatatgtttatttttttttttttttttgagacagagtttcactcttgttgcccaggttggagtgcagtggtaccgtctcaccccaccgcaacctctgcctcctgggttcaagcaattctcctgccccagcttcccgagtagctgggattataggcacgcaccaccatgcccagctaatttttgtatttttagtagagatggagtttcaccatgttggccaggttcatctagaactcctgacctcaagtgatctgcccgcttaggcctcccaaagtgctgggattacaggcatgagccaccacacctagctatgtttaattttttgtagaggtgtggtctcactatgttgcccaggctggagaattcctccctagcactgtatgcttcaggcatgttgacctacttttggttccctgaatatgtctttccggttattctgtgagtttccacaaactgtttcaattgcctgaaatacattccaccagctcatctcctttccattttactccctccctctgacagggtaaatcttatttgttcattccttgggatgtctttcctgcaccctcaagactgggccaggtatcttctctcatgtactttcataagcatcctgtttttgaagcactaaatacacactattgtagctgaatatttatttcatggtcttccccagtagattgcaagttccttgagaggaagacattctgttcaccatacctccctagcaccttgccacatagtaggcaatcaataaatatgtactgaattaataggaaaacatttaatcaaagaaaagaagcaccaacactggtatacatacaatataataatcaaattataatctatgctatttcaagttcatttacaaactggtttgggagaactctgaaactcattttctcacagaatcaacattaaatgtagatgataactagctacctcctgaaaagcctatttaatctataatgtaggtaaactgtattattcacagttactatagactctactaaatatcagtaatatttctggggaaaatgtattaagaattccaatttggtcatagcttgaattaattatttctggctgtagctcaggaatagaaatacacagttccaatttccataggtggttgaggacagaagttctattagagagggaatgaaaaatgactaaaaactctagggaactggggaggcaaggattggccttctgctgccattaatctttgggaacattacctaatttagggacaactacttttcatctcttttcttttccttcaagaatcctaggaattagatgccagattcctatttattgtcaacgcttctgacttcaaaccagggtttgttttttttttttttgagatgggagtctcgctctgtcacccaggttggagtgcagtggcaccatcttagctcactacaacctccacctcctgagctcaagcgattctcctgcctcaacctcccaagtacctgggactacaggcacgcaccaccacgcccggctaatttttgtatttttagtagagacagggtttcaccatgctggccaggctggtctcgaactcctgacctcgtgatctgcccaccttggcctcccaaagtgctgggattacaggcaggagccactgcgcccggccccaactagggttttttaaccacagacaagaaacgatctaaaaggttctcatatatgttctttttccttaagcaagcattctgtattcagtattatatacaaagaaagctaagtaagcaaacaagcaaaaaacaagagagttattaactctaggaaaaacaacagtcaaagaaaaaaatttaattatagctcaacagtgagatgtttaacaaagttattatactgtaaacaatgaacactgatctaacaaaaaattatgatcaaactgaaaattaagacatgggaaaatggaacaaggagagtatattgaaaatattttcttccaatctatgttttgcattttcattttcctaacagtatttttcatactacgtatatatatattttttaccaccatgtgttcaagtttttaatctcaattttttcttcaaagtttgtgctttttgtatcctgtctaaaacattgtcctacccaaaagttgggaatatttttacatatgtatgctcctaagaattttataattttagctctcatatttaattctatgactcatttcaagttaatttttatgtgtggtgtgaaataatgttcaagacttctttttttccttatggatatccaattgtcttagtacccgttactgaaaactataatttccctattgagttaccttgtctcctttcttaacagatcaactgacaatctatgtgaggttctatttctggactctctttttctgattcattaattaacttcttattaagtatttatataatgtagtgtgactcgttcaaaattgttttggctatagtaagtcctttgtattgccacataaattttatatttagtgtgttaatttatgcaaaaaagactacaaggattttgattaacagcattgaatataaaaatttacagagaactggcatcttaacaatattgactcttctgattcatgaacataatctatctgttgtttatttaaatttgctttacttattctaaacaatgctttgtagttttcagtacatattttttgttgactttattctaaattagttcatgattttggatgctatttcaaatcgtatttttaaaatttcagtttccaatttttattgccagtatacagaacgagaaacgatttttatatgttgaacatgaattctgggaccttgataaaatcactcttcgattttctatgtggataatcctgcctgtgaatatggacaattttacttactgctttttgatatgtacaccttgtatttctttttctagccttaatgcacagctaagaccagaaccagaacaatgttaaagggaagtgatgaggaaaggctctcttgtcttgttcctgatcttagaggaagagcatcagtctttctgcattaagtatgatgttagatgtaagttttcataaatgccttttattgtgataaagaagttcctttctattcctgatttgttgacaggttttgtcaggaatggatattgaattttgtcaaatgcttacattgaaataatcatatggttttcaatttttatattgttcatgtgatgatttacagtgattaattcagtgttaaactttgtattgctggtatacttttttacatactggtggattcaatttgctaatattttgttaaggactttcacattcattaagaacactgacctatagttttctcattattttgtttgtctggttttggtaacagagtaatcctgaagttataaaattatttgggaggtatttctctttcatttcctaagaaatttttagaattggttttactttttatgttaaatgttcaatggaatatagcagtgaaaccattgaggcctcaaattttcattatgatttttattatgaattaaatttttctagttgatacagggctatttaggtttttaatttctttttgagtcagctgtgatatttatggaatctatatattcatataaattttgttggctttcttgacataaagttgttaatgatattctcttattatctttttaatgcctatagggtctgtagtgacagtctttttattctattttactgctgacatgggtaaattactttcttctctatttttgttttaagttttacaagttttattcgttcaaaacaatcagtttcaagtttctttttttttgttttttgagatggggtctcactatgtcgcccaggctggaatgcagtggtgcgatctcggctcactgaaacctccacctccccaggttcaagcaattctcctggctcagcctcccaagtagctgtgattacaggtgtgtgccaccgtgcccggctaatgtttatatttctagtagagacggggtttcgccatgtttgccaggcctcatatgatccacctgccttggcctcccaaagtgctgggattacaggcgtgagccactgtgcctggccccttttactatttgacataaggtttgctttttctgataagtatagctattcctgctcactttaggtttctctttgtgtggaacatctttttccatctctttgctttcagtctatatgtatctttacagatgaagtgaatttcttgtaggcagcatatagttgggtgatgttttttgttttaaaacaatccattcagccagtctgtatctttaaagtgaataattcaatccattaacatttaacgttatgttttacatgtgaggattgccattttgttaattgttttatcgttgttttctgtatcatttgttcctttctttctctcttattttttatcattgtggtttggtggctttctgtagtagtaacatttgagtcctttcttttcctcatttgtgtatctgctctaccaatgagttttgtactttcatgtgttttcatgatggtagatacaattatttttttccaggtgtagggctcctttaagtttttcttatagggctgttctagtgatgataaattccttcagtttttccttgtctgggaaatattttatttctcctttacttttgaaggatagctttgttgggtatagtatttttggctgaaagctttttttttcttcctttcagcaaattgaatatattatcctagtgtctccttgcctgtaaggtttcttttgagaaatctgcttttactctgttgaacattcccttatatgtgatttgatgtttttctcttgctgcttttagaattctccctttgtctttgacttctgacaacaatgtgccttgcagaccttttcaggttgtatctatttgataagtctttgagcttcctgtatctggatgtctacagctcttgctagacttgggaagttttaaactattacttaattaaatattttttctatgcctttgcccatctcttctccttctggaataccccaaatttaaatatttggacactttatggtattccataggctttccccatccctttttattcttttttcatctgactgatttttttttttttttttttctgaggtggagtctcactctgtcacccaggctggagtgcagtggtgcaatcttggctcactgcaagctccgcctcctgggttcacgccattctcctgcctcagcctcccgagtagctgggactacaggcacccgccaccacgcccggctaatttttttttttgtatttttagtggagacagggtttcaccatgttagccaggatggtcttgatcttctgacctcgtgatccacccgtctcggcctcccaaagtgctgggattacaggcatgagccaccgcacccggcctttttttttttttttaagacagagtctcactctgtcgcccaggctggaatgcagtggtgcaatcttggctcactgcaacatccgattcctgggttcaagcaattctcctgcctcagcctcccgaatagctgggattataagcaagcaccactacacctggctaattttttgtatttctggtagagacagggttttgccatgttggtcaggctggtctcgaactcctgacctcaagtgatcctcctgcctcagcctccaaaagtgctggcgttacaggcatcagccactgtacccagcttatttttgtatttattagtagagatggggtttcaccatgttggccagactggtctctaactcctggcctcaagtaatcctcccacctcaacctctcaaactgctggcattacaggcatgagccactgtgccagtcaaatgttttaattaatgaattttattttattttactttatttattttttaatttttgagacagggtctcacttactctgttgtccaggctggagtgcagtggcatgatcatagctcattgcaacttctgcctcctgggctcaagtgattatcccacctcaacctcctgagtagtgggaccacagacgtgtaccatcacactgagctaatttttgcattttcagtagagatgggtttttgccttgttgctcaggctggtcttgaattcctgggctcgagcaatctgcctgtctcagcatcctgaagcactaggattacaggtgtaagccaccacacccggccagattttttatgattacattttatttccactattggctcataactgatactgtgttttctatttctagcatttccattttactgttttacaattttcatactatttctaaaattctccatcttttcttgcatgttgtttatcttttctatttgatgctttaacatattattcatagctatcttaaagcccttgtctaatagttctacaatctgggtcatttctgcatctggctttatcagttgctttatgtcttggcaatggttgtttttttaaatgtcttttttgttattttgcaatttctattgaatgctaggagttatgtgtagaaggatagtacagactgaggaaatgatagttacatccagaattgagcatgcttcttcctttgaggtgatgatagtatggtgggggaggggactgagtgaatgtagtcagcgctgagttctgtttaggttctcttgttacatttacctttggagcaccatgaacctcaaattcccccagcaatgggatacttctagcttgtaatactgtgtgtcaagggttttgctaagtgttcctgccacattctcagctttcagtagtcctgcacgcctgtaggatagtaggttgtctctctttcccagtggtagattgatcttgaaggtttctcagtgttaagttcatagtgggggttgggggaccttttgagtctcctggtaccaactcagcataagacaaattttttgctgcagctgagccttgggggtgggactttcttggtgttcctgtcccccaccactaacaaaactatgtcttgtaactgcaggtggtgctaaaggggtctctgcctctaccctggcagtaacagatctctgtcttatatcagtgcagggtcctgagtccaacagggtttcctgcccactccccaggggtaggcagcatttgtccctatcccatcaccagaagcagtccatcatggactaggctttgaggttggaggagggggtactctgcctcttccacaatggcttaaggcttttgtttagtgtaagaaaggggtattgaaaataggcagagttttgaacttctgctccactaatggatatgctctcaggactcccagctagcacctgctagatgccagtggaaataaagcctgtgagtgagtataaactcccctgtgtcaggaccacttttattgtgatcttttttctttcttttttatttaaattttgtttctgaaaaaaatttgttcttttttgtttgttttgtcttttcctttgtttgttttttatagaatagagacgaggtcttcctctgttactcagcctgatctcgaactcctaagctgaagggactctcctacctcggcttcccaaagtgctgggattacagatgtaagccaccatgcctgagtgaacattcataaaagcctaattccttcacttatagtagtgctagaacattagctattttcttcatatccacctttataataaccacctcttcttccccttctccgccaaaggaaaaaaagttcatatgttccatttcttctctaaacaaactagtaaaaaaaggaagtttcctctacataagaaaagtcatctaaaaaaacttagtaataacatcatttttttttttttttttgagatggagtctggctctgttgcccaggctggagtgcagtggtgcaatctcggctcactgcaagcgctgcctcctgggttcacgccattctcctgcctcagcctcccatgtagctgggactacaggcacccgccaccatgcctggctaattttttgtattttttagtagagacggggtttcaccgtgttagccaggatggtcttgatctcctgacctcgtgatctgcctgcctcggcttcccaaagtgctgggattacaggtgtgagccaccgcacccagccgcaataacatcatatttaatggtgaaagactaaatgccttccccctaagattggctacaaggtaaggctgttcagtcctatcatttctatccaaaattgtactagtcttccttcaacgtaataggcaaaacaaataaataaaaggcatatatattacaaggaagaaataaaaatgtctttatgtgcagacaaaatgatcctatatcttctagaattaaccaaaaatccacaagaactaataaaaggagttcagcaaggtcacagaataaaaggttaatataagaaaatcgataataattctatacttagcaagggaaacctggaaatttacattttaaaaaatgccatttacaggagcataaaaggacacaaaatacctatggataaatctaacaaaatgtattaaaaaaactagagaacattgtggggataaattaaaagtgaacgatactcttttcagggaccagaagactaaatattattcagaagtaaattcttccaaattagtcaacagatccaacacaattccaacaaaattgtatacacttaaaatgctgattctaaaattcatacagaaaagcgaaggacctacaaaagacaaagcaatattgaaaaggaatacagtagggtaaacactatataatttcaaggcttatttatttatttattttttggagacagagtcttgctctgttgcccaggttggagtgcagtgtcatgatctcggctcactgcaacctccacctcctgggttcaagtgattctcctgtctcagcctcccgagtagctgggattacaggtgtgcaacaccacgcccagctaatttttgtatttttagtagagatggggttttgccatgttggtcaggctggtctcaaactcctgacctcaagtgatccacctgcctcggcctcccaaagtgctgggattacaggcatgagccaccgtgcctggccttcaagacttattataaagctacagtaatcaagccattgtagtataaggctgatgaatagaccaatgaatgagaatagagttcagaaacagacctacacatacattgccaattggtttttggtgaaggtgccaaggaaatttaaggagggcaaaatagtcttctgtgttttgatgagtgttgtaacaactgaaaatccatatgtaaaatgacaaaccaaaacaaaaataaaaaaatcagaactgctacctttattttgtagcatataaaagaattatatgctacaaaaataatagtttatagacctacatctaagtcatctatcacttagctatgggatatgttctcagaaatgcattgttaagggaatgctgtcattgtgagaacatcacagagtgtatttacacaaacctatatgttatatgtatttttatttatatatatatttttcatatgaaaaaccaaaggacctagcatcattactgaataccaattatttctcctacttgatctgcaatgcaatgtcaagtgccatttattatgtttctatatatgctccattataatcttatgagaccagtgttgtatatgtgctgctttgttgactgaaatttgattaagtagcacatgactgataacctaaagctatggcatttttagaagaaaatataagagggtatctttgtgaacttagattaggcaaaaatttcttaggactcaaaatacaaaaaaaaaaaggaagaaaaaaattgatatactagattgtttccaaatttaaaacttctgttctctgaaagacaatgttaataaaatagaaatcaaatccatagacttggaggacatatttgtaaaagatatatatattacagaacttgtttccaaaataaagagttcttattaccccatataaatatggactcaatatgaacagatacttcacaaaagaaaatgaatagacaaaaggcaccaaaaaacatgctcaacaccatcagtcatcgggaaaagaaaaattaaaagcacgatgagatgccactacataccgacaataacggctaaaatgaaaaagatggcaatacctagtgctcacaaagatatcaaatggaactctcatacaatgtcagtagaaatgcaaaataatatagctactttgaaaaacaatttggcagttttttttatcaagttaaatctatacttttatgactcaccagttctatttccaagtatttgctcaaggaaaatgaaaatatatgactacacaaaggcctgtacatgaatgattataccactttgacttacaatagtctaaaacagaaatattccaaatgtccattaataggtgaaagaataaaaaaaaaaaaaattttaggggccagatgaggtagctcacacctataaccccagcgctttgggaggctgaggcagaaggatccctagagcccaggtgttcgaaactgcagtgagctatgattgtggcactgcactttagcctgggtgacagagcaagactctgtctctcaaaaaaaatttttttaaagttttgttcccatacattggaggatgtaaggaaagcaataaaaaggaaaagtaataacatatacaacaacctgaatcaatctcaaaacctttatgctaagtgaaagcagccagacacaaggctacatgctattgttccatttttgtgacattctggaaagtgtaaaactatagtgacagaaagcatatctgtggttgccaaggtatagtgatgggtggaggggaaatgctacaaaggcacatgggggaactttttggcatgacaggaatatctctattttcatggtactgatgtttatccaactatacacatttgtcaagcctcatccaaccatacattgtatttatttttttattttattttattattttattttattttattttatttttattttattttattttattttattttatttttattttattttattttattttatttgagacagagtcttgctctgttgccaaagctggagtgcggtggcacaatcatagctcactgtagcccagatcttctgagctaagcgatcctccctcctcagcctcccaagtaactaggatgacatgcacactaccatgtctggaccaactatacattttaaaaggataaatttcactttatgtaaatatacctcaacaatcctcatcttaaaaaagtatgttacaaaaaaaatctcagaatcaagaggggtgacactcgtcagtatttacaggttctaccatggtggtaaaaacaactaccacaaatatatgataagtttacttgacagttacactaattttactaaattctaaaatcctatatttttcacttttagacaaacagaatgtgagcaaaattacctctgtagggtactgaacatggaatatcaaaggaagatgactgacaaataaaaaaagattatttgcagtaataatgtagtaaaaccatgggaatactaataataaagatgaatatagttcgggcacggtggcttacacctgtaatcccagcagtttggaaagccaaggtgggtggatcacttgaggtcaggagttcaagaccagcctggccaacatgatggaccctgtctctactaaaagtattaaaaaaaaatttgccaggcatggaggcacgtgcctggaatcccagctacttgggaggctgaggaaggagaattgcttgaacccaggaggtggaggttgcagtgagctgagattgagccactgcacaccagcctgggcaaaagagtaagattccgtctttaaaaaaaaaaaaaacagaaaagaaaaaaatgaatatatatataatttaaatgagaaagtataacgtatagtatcctcccgcatcaaaatatacctgtatattggaaaagataaatatatggttggatacagcattactgtttactttgagtatgtctgaatttttccataaaaaagagttaaacaggctgggcatgttggcatgtgcctgtagtcctggctacttgggagactgaggcaggagaatggcttgaacctgggaggcggaggctgcagtgagccgagatcacgccactgcattccagccagggtgacagagtgaggctcccaactcaaaaaaaaaaaaaaaaagagttaaacaatagcaaagaaattctgcaatatataaataacttgcttaattaaaaacagtaaaagacattgaataatttgtatgaagacaaatacatgatggcccagcaaagagtaccttggcaatagcagtttgtttaaacatgcgagttatcaaccccatgactgtctccatggcacctgaatttggagttctcattattttttcccactcttcaaagctggtattcaattcctatgtgggaaaaaataacactgtttatgaatatagcataacgaacagaacaaattaatgcaatcatgaatcatgtcctactttttttccttttctctatagaaagatataaaaagaaaatccccaaagattccaacatgttcatttaaaaacatcaatgcagaggtaggtcagtcacattttcaaaattatagaaaccaatgataagctgtgggtgaaaacaaagccctttgctaacagcataaatcaaacaattataatttcttctttttttttgagacagagtctcgctcttgttgcccaggctggagtgcaatcgtgcaatctcggctcactgcaacctccgcctcccgggttcaagcgattcgcctgcctcagcctcccaagtagcttggattacaggcatgcgccaccacgcccagctaattttgtatttttagtagagacagggtttctccatattggttaggctggtctcgaactcctaacctcaggtgatctgcccacctcgacctcccaaagtgctgggactacaggcgtgagccaccgcaccctggcctataacttcttaagaagatacattctgtaaaatgaacataagaaacataagaaagcagagtagtaaaaatgtataaagcagctaagtacttttgtaaaaagatgtggtttgatttaaataaagatggggaatattaaataaaattaatatgaagtacaaatataatcatatgttgattccattttatttttctttctaatactaatagataagaaaatcagattgttcttattttagaagtaacatattgctcaatgtttacaaaatgcttataagctttcaagataacaatgaaaaactctgttaataaagtcattttcagatttgcagaaatttcagagaatatataagcactgcagtctccaaaagtaaacatggatgaggattaggtaaggattagtaaactggttttctgatatactgaatttcacgtcttacaacatggtcacagagttttagaatttcaagaatagggctgcatgaagtttttctagaagagagttattcatactttaaaaagaaattctagagcaaggaacacaatttcccttgctaattattgggtttcacaccttctatttagaattcttttttttttttttgagatggagtctcgctctgttgcccaggctggagtgcaatggcgcgatctcggctcactgcaacctctgcctcctgggttcaagctgattctcgtgcctcagcctcccgagtagctgggattacgggcactcgccaccacactcaactaatttttgtatttttagtagagacgagttttcaccatgttggccagctggtctcaaactcctgacctcaggtgatctgccgacctcaggtgatctgcccacctcagcctcccaaagtgctgggttacaggtatgagccaccgtgcctggccgatatttagaattcttaatactacatctctgttgcaattgaagttcttttttcagcaaaaatactttttttttaaaccactaggttaccatatctttttatgcatctgatgaataaaattgaattcttcctgctttcttgctgaaatacaaaaccaatgtataggctctattaattaaacctattttaagaaagcaaacctttccttctgtgaaatatgaaatacgtataatctttaatagtgtaattcaaaattatttaaagtaagactttaaatcaagcaacggttctcaccttggcagctgctgatggaagatcaaatggaatacgctgtctgactttagggggtagctgggttaaaacttcagtctttaatcttctaatcattatgtcacttaatagctggtgaagttcattaagatttgatgcccctctacaatcccactgaggtcttttaccaaaatatctgttaaaatgaagacaaaacatgtagcaaaattgaatgctggagttaagaaaataatttatccaatgtgctcttccttttaatgataaggagccatgacactgttttcattgatatttctgaatgaatattagtttcaaaaagctcagcctgaaaaacagtaatgaataagatttgacactgctttaaactagagaagatgttagtgtctaagcatactgtttacactgagttaatgcaaggctgtgatgaactgatgactgtgaattgcactaggtcactgtttgtaaatgggggtgttattggcattttgagtgggctcacacatggtggtgttttagcagatctatccataaagtaggcatgaactgccagtgcatcagccagtcattataataaccaaaaccacccagaacattttctgtgccctctaggaggagatattatctccaatagggctgttaaagcatagcagattgattacatggtggtctcttcttcctttgaaatacttcttcctttctaaccctttcctggattgacagcaaagggataaaataaaagaacacaaaattactatgaaagagagaatgagaggagacatcagagaataagtgctttgaagaaatatttagaaggcataatgcagatagaaaagtggtaactgacttggcaaaagaaaggaagcgataacttaaactgcttgcaaaagacaagttattctctagacctttcagaaaattagaagctcaaagcaccaagtactgtgaacaaatgttaacagaagggttgaaatctagtggatcaattgaacttacacattaggacaaccgatccaataacatatccctatcaatgtgacaaccaaaataccagcccataaaattcccaatcatctcctaggggtccatactacccactactgaaaacagctgttagagaataattaacaaataaaaaattcctgttaggttggattatgattactaatattaataatttaagtaactatcattttactggataaaaaatactgggtgtattttagcacaaataggtgtcaatttgagaaatgtggaactcgttaacattagctttttaaaaaataaatattaaacataaacaatacacataatattaaaaagatatacttgtagccgggcacggtggctcacgcccgtaatcccagcactttgggacgccaaggcgagcagatcacgaggtgaagagattgagaccatcctggccaacatagtgagaccctgtctctgctaaaaatacaaaatttagccaggcatggtggtgtgtgcctgtagtcccagctactcaagaggctgaggcaggagaatcgcttgaacccgggaagcagaggttgcagtgagccgagatcgtgccactgcactccagcctggtgacagagcgagattccgtctcgagaaaaaaaaaaaaaaaaatatatatatatatatatacttgcatgtagagtcaattacataagtatagtgaatgaatggaatctactgtatgataaaattatacacataccatttagttgtcatcaataagaaatttacttgtttaaaaaatctaagtgctgtcactatataaaaatttttaacggatttgcttataattgttataaattgaattgctgaaacttgttcattaaaattttttgacttcctttaatgcatcatgtccccatatttatattaaaaattcacacactaataaaaatgggaaaatacttgccaatacctgttctgcacctatttttccattcatacacttaggtatactttgatcacacggtcacaaaaaaaatctaacattcagaactaccaatattgggaagaagttggtaggtggtggtttttgttttattttgttgaaaatgcagtgtttgccattaaaatggattcttaagcacactctccacttacatgagacattgtacaggtgtgcagtatgctagctggaggccttttggtatgactgctacatgctggcaaagacaacacacaattgtcttcaaacaggctaaccacataggccacacttgcctcctgcagagtaccaacagttgtactcccaaaatgcagatctgttttgaagtctgagcaatctattttcagtgtgtcatagtgccaggacctggtctgtaacagtgaggatttcctcactgctccaggggagggtacactattgagagaagtttcagctagttgcctcgtgggtcttatgccactagttgatcctaagcgccatatgcctggtatgaaccatggttcagaggaattatttcttgttacccactctccccacccacatctctttcatctagagcttcgaatgctagtggtggcgtttgttctaaagagtggtgacaataacacatttgccaaaaccccagcctcatgtttggggtgcaaaggggaaataagagggattagggaggactagaagaggtgccacctgtaaacctttagtctctttaaatttgctgaatttgaagaatttgcccaacatctcatggatggtaatagtggtgctgagatttgaacttgggcagtctgactccaaagtcttgctttactaaaagccaacttttacctaataatataaaaattatattaaatatatttcttgggattattttcctatgctatttacacactattttgtgtgtgtgtgtgtgtgtgtgtgtgtgtgtgtgtgtgtgtgtgtgtattgggggcagctacacaaaagcaggagattctgagactaggaaacattcctaactttaggttttggcctttatttttcttaattctcaattcctacatatataaaatgggaagatccactgtttgggggatggttgaataaactgtggggcatgccaactatggattattaagcaactattcataagaatcacttagatctttatgtaaggggtaagatgaatgttgaagatatatgttaaatgataaatgcaagtctcagagtaatatgttgggtatgaaggattatgtagtatgtgtgtagatgtgtgtatatatgtatgtctgtataataatggaaacagttccagaagaacacacatcaagatatgatacattgcttaacttcggggtcatagttaaagagaccgaaaagtttacgtgaaaaactggggttttgttaccccattttgttttcactttgtctatctgaaagtttacaataagcaaataatgcttttgtaattaaaattcaatgacgtaaaaagaatcttaaaaaaaaaataccttcaatagctcccacttcatagcattggtctccaaagtgtggggatgggtagactccagaggcgttcaagtcaacccactgaggggcagaaggaacttcctctacatattgtattcttatctcagctttctaaattagcttctctttcatgtaagttttaaaatatacataatgcttagaatagtaacatgaatataattcatgcattggcagtatgctaaaaaacaatgctttaaaatggggtgtatacagagttgagaagaggggcaagtgcctagcaggcatgggcacaacttgactgacagaattggccagtaaagatacaatgagccctttttagagttagacacttttgttacttaaacagaattacgaataaaaagtgaagtacaaatatgagtctataatgaaaaaaacacaagttacacaaaacaaaaaatttataaatgcttacagatgttcctaaatccagaaaaataacactttttaattaaccacttatcacatctataatgttttttcaacattgtccactgcttatgctttgactgcctcttcaggtgacaataactttgtaatatttgagaaataggatacttcagtctttactcaagcatggatgatcgaattttgttgtttattaatgataattttttaaagtttatttcaagtttataacttactgtcatactctgtgtgtgtacatatatttctaattataatcaaatttgaaaaaaatctctatcaaatttctgtcaaatataagctataagaattgaaagaattattcgcagattatcctctggctctctacatttcaaccttgcttctcttccagtactcacatgttcccagcatctggcaccataagacacgttcgcactgcaatatgtccactcacccattaccaggattatttctggaagccattcctatactaggttggctagcaataacctaactaaatacataaatataacccactaaatccaaaccaaacataccgctaatataatttcttcttagcctgatcccaacaacacttggtgataactccatcacaaaacacaaggaaaaatatgagaagaggaagatgtgctgaaaagagatcttttaatatattgaaagtgtctacttctataaatttgacagggacatatgatcctgtgaaaagtgccaaaactccctcctagggtcttgaaatggcctaaaaagtgagtgattcttttttttccccccaagagatgggttctcactatgttgcccaggctagaatacagtggccattcacaggcacaaccatagtgcactgcagcctcgatctcctgggctcaagtgattatcctgcttcagcgacctgagtagctgggactacaggcacatgccaccaggccgagctaaaagtgaaagattctgaagattaaggtccatagttgcatgggaaggaaagaaaattatcaaacaaatttgtaaatgcattatcaaagaggtaaagtgcatagaacaaagagaaaaggtgtaaatgaataagaaaaatatgtttaaggacaaagtataagcagtatgctttgggggtaggtttaaaacaaaaggatacttaattcctaacaaactaaaattagcaacaaccaaaaaattgtaaatgcccctaaagacatttatgaaacatgaactttcttttgagcttagaataattattttctcattcagttttacagagtaagtaaaaattcatttattcttttctaaattgaaagaataaacatacgccttttaatctccttttgatcatatataatttaaaaaagtcatttcccagtagcatttaacattagcttatgatgatgaaacaggaagtttatggccaagaacatatatgcttatctgtgttcatgaacaaacacacatacacatgcagagttaacttttgactttggaaatcaccctctggttttttaaagttaggttctcttgtgcctcttgtagcaatcctttcctctcatccttggctcctggcaaccattaatctgttttttgccttagcagttctgcacattctggaatgttatgtaatataaatagaattatgcagtaagtagccttttaaatcttatttctttcacttagcatattgcatttgaaagttatatatgttattgggtatattaatagttcattgctttttattgtcaagtaatacattccaatgtatggctatatcacaatttctgcaatcacattagttgaaggacatctggattattccagttttaggtgattataaataaagctactataaacagctgcatacagatttctgagtgaacatatgttttcatttatctttactaaatacccagcagtaggatttctgatttgtattgtcagtgtatgccataatgtttccaaagtggttgaacattttgcattcccagcagcaatgtaagcaatgtaattcccagcagaaagttccagttgttcggtaaccttgccaccattctaatgcacgtgtactggtattttaactcacatttctctaacgactaaggtcttgggcattttttcatgtgcttatttgacttctgtatatcgccttaggtcaagcgcctttctaaatcttttaactgtttttaaaattattttgttttcttattactgagttttgggatttttttttttttttttgagacagagtctcattctgtcgcccaaactggagagcagtggcacgatctcagttcactgcaatctccacctgccaggttcaagcgattctcctgcctcagcctcctgagtagctaggactacaggtgtgtaccaccatgccgggctaatttttgtatttttttatttagtagagatggggttttgccatgttggccagggtggtctcgaactcctgacctcaggtgatctgcccaccttgcctcccaaagtgctgggattacaggtgtgagccaccctgcctagctgagaatttttaatatattattttaaaaattccttttgtgtacttataaatttatatattcctttatcaaatatgtagtttacaattttctctccaagtttatggcttgtctattcacctcttaacagtgttggggagagacattttaagttctgatgaggtgaaattcatcacttttgtcttttatcgttcatgaagtttgtgccccatctaaaaaaatccttacctaacccaaagtcccaaatatacaatccatttatcattaaattttgcatattgtgtaagatatggtttgggtttcttcttttcacatatggatgtccaattgttccaagagcatgtattgaaaagactagcttttctccagtgaattgtcttgcatattgtcaaaaatcaattgatcacatatatgggtctatttctagattctatatgttccagtgatttacatgtgtctcctgattgacgactgtaaagaaaaatagtgtgaatcttattcttttcttctttttcaaagttcttttaaaaaaggaactttgtctttgcatataaattttagatttaaaatgtcaatttctacaaaatcttgggtttgattgttattgcacagaatccactgaacaatttgagggaaactgccatttaaaaaatattgaggccaggcacggtggctcatgcctgtaatcccaacactttgggaggtcaaagtgggagaattgctggaggccaggagttcgagaccagcctgggcaacatagcaagacccaatctctataaaaaatgaaaaacaattagctgagtgtggtgttgtgctcctgtagtcctccctacttgggaggctgagagaggaggattgcttgagcccaggaggttgaggctacagtaagctatgattgtgctactgcacttcagcttgggtgaccaagcaagatcatgtctcttaaaaaaatttttgttgaccaggcgcagtggctcacgcctgtaatcttagcactttgggaggccgaggcaggtggatcacctgaggtcaggagtgtaagaccagcctggataacatggcaaaaccccatctctactaaaaatacaaaaattagctatgagtggtggcgggcacctgtaatcccagctacttgggaggctgagacatgagaattgtttgaacctgggaggcacaggttgcagtgagccaagatcgtgccactgcactccagcctgggcaacaaactctgtctcaaaaaaaaaaatttttttttttttagtctccctgtccacaaacatggtataccactccattcatttaggtcttcttttatttttcattagtgttttgcaggtcttgtaagtttaactttataaacaattataaacaaattttcaaactgttttccaaaatggttgtagtattttgctttccaaccacataagtttaacaatgaaacagtttgacacatgatagaattgggggaaaatttacaacactctgttcttatatcaaataatagtgccttgcaaatgtaacagaatgtttagttctggtttatcatccaagaagaatattatagactagacaagatttagaaaggggacacaatctaattgttaacataacagagggagataatggagtgtggaagttagaggaggatacattgaaaaactgaaattattcagagtgaaatgatgatgacagattacaaatagaattgacaaagaacagcccagataaacagaacacaaacttgctccctaaatactgaactatcaaagtgctctgaaagtggaataaaggtatcatcatgaaaagagtagaatgtaaattacaaagtaattggagatcatcccatcggtcaaaagagggacaatttgatgatcaataaggattataaataaaattgattcaaaaaaaacatgagttaaaaactctcaaatactcaataaactagaattagaaagggtctttcctcaccttgattttttctctttttttttgagatggagtcttgctctccatctcaggagagcactccatctccaggctggagtgcagtggttcgatctcggctcactgcaacctctgcctcctgggtccaagtgattctcctgtcacagcctcctgagcagctgagattacaggcatgcaacagccacctccagctaatttttatatttttagtacagatggggtttcgccatgttggtcaggctggtctcgaactcctgacctcaggtgatccgcccacctcggcctcccaaagtgctgggattataggcatgagccactgtgtctggccctcatcttgatttttttttattattattatactttaagttctagggtacatgtgcacaacgtggaggtttgttacatatgtatacatgtgccatgttggtgtgctgcacccattaactcatcatttaacattaggtatatctcctaatgctatccctcccccctcccctcaccccacaacaggccccggtgtgtgatgtcccctttcctgtgtccaagtgttctcactgttcaattcccacctatgagtgagaatatgcgatgtttggttttttgttcttgtgatactttgctgagaatgatggtttccagcttcatccatgtcccaacaaaggacatgaactcatcattttttatggctgcacagtattccatggtgtacatgtgccacattttcttaatccagtctatcattgttggacatttgggttggctccaggtctttgctattgtgaatagtgccgcaataaacatacgcgtgcatgtgtctttatagcagcattatttataatcctttgggtatatacccagtaatgggatggctgggtcaaatggtatttctagttctagatccttgaggaatcgccacactgtcttccataatggttgaaacagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatgagcagtgatgatgagcattttttcatgtctgttggctgcataaatgtcttcttttgagaagtgtcttttcatatcctttgcccacttgttgatggggttgtttttttcttgtaaatttgtttaaaatgtaatacttataccctgaaagctacacaacattgtaggatttcttttttaattaaataaatggaaagacattactgttcatgaatttgaaaacttactattataaagatgctaaactcccaaagttaatctacagattcaatgcaatctgtatcaaaattccagctgacttctttgctgaagttgacaagctgatacagaaatttacataaaaatgcaagtgacacagaatagccaaaacaaccttgaaaaagaacaaagttgaaggacttaaacttgccaactttgaaaataaaaagcactggacaccactgtaagttgctaacaaaacaacttattacattgaaaattaataaatgagaaggaaaaaatttatcctgcctttcttaagcaaactgaaccagtgaatgtccacataataaattatgatgaggttttattttaaagaggcatgccaactatttttttttttgagatggagtctccaggctggagtgcagtggcgtaatcttggctcactgcaagctccgcctcccaggttcacgccattctcctgcctcagcctgtagctgcgactacaggtggctgccaccatgcctggctaattttgtttttgtatttttagtagagatggggtttcaccatgttagccaggacggtcttgatctcctgacctcatgattcacccacctcagcctccaaaagtgctgggattatgggtgtaagccaccgcacccggccatgaggcaggccaactattaaatgaagaaagtgtgttagaatatcaccattctgcaatgtccaaaggcttaataatgtactgaacattcacagctgctaacatcataaaaagagaggctttagatatctcctaacagaagaaaacatcactacaaaggagaattgtctccaaatattagaagtttctagatctaaatacgaacatggaaatacagaggacaaaggaacatgttaaacaacaccatgaggatgcaggcagcagaatctagattacaaaaacaatttagattcttccacaatggaaaaataaataaataaaacaaggaaataaaagagaaacccaagacttcagtgacatctatcatttgctgtatgtgagccttatttgggtactgatctatacaaactacagggaaaaaactaaaaagaaccccaaaaaacagtaaaattatgtattcacaaaacaactggaaatttcaacctttacttcattttttataacataaaaagtgcattttaattatgtaaaattaaatatgttttatgtgtgtgtgcatgtttgtgcttttccataggttactggggtacaggtggtctctggttacatgaataagttctttagtggtgatttgtgaaattttggcgcacccatcacccaaccatttactgcatttttaatgcaatcaagggatttaatgcaattaattttaatttttaaggtataataatggtattataattaattactttttaaatggggattaaaatttatagttttttttaaattttacttttagttccgggatacatgtgcagaatgtgcaggtttgttacataggtaaacgtgtgccatggtggtttgctgcacctattaacccatgacttaggtattaagtcccgcataattatttttaagaacagtcccggccaggcatggtggatcatgcctgtaatcccagcactttgggaggctgaggcgggcagatcatgaggtcaggagattgggaccatcctggccaacacggtgaaaccccatctctaataaaatacaaaaaattagccaggcgtggtggtgcacacctgtagtcccagctactcaggaggctgaggcaggggaattgcttgaacctgggaggcagagggtgcagtgagcagagatcacgccactgcactccaaccttgcagcagaacaagactccatctcaaaaaaaaaaaaaaaaaaaaaaaagaacagtccttccttactctttagagacatatgtgaaacattttatagataaaatacaatctctaggatttccttcaaaataatatggagtagaagaggtagatgggagcatagcaaaaataaaactggtcatgagataatcattgttgaagctgggtaatgagtacatggggggttcattatactataggatgtacttttgtatatgttaattttttccataataaaatatttaaaatatcagggaataaactaagaaataaaagtcatgaaatccaggaatgtgaggatccaacagagcagaatggcccaaggaaattcagggtgacagctttctgccatgcctaaagaaaaattggtttagattggagcataacagaaggctgtgggaggaaaatctccaggaaaacgaaaaaagattattttatgtgcttataagacatgttggaagttgacagattggttggagtctttcagtgaaaaagcagcaatagctatatagaaaaccaaacagatgggaaaaaaatgaattataaggtaaacaaaaagttgactaagaaaggaacagtcaacttcttgatttagtagagaataatattaatttatttagtccattaatttaatatacttagtcaataatataaaactggacactgaattaccaaataattcaaatactggaaggagaacagaagaaaacgggtgtcaaagggtgtttatattcttgttttttcactgtttagttatgtgatttgacaagttacttaaccgttccaaatacagcttaacctttccaaatacagcttcctcatctataaaatggacatactatcatctgccttgtaggattgttaaaggaattaaagataatacatctaaaacacatggcatagtatcatatataaaatataatcatatagccaataaaaattatgtattttagttactgatatcaaaaaatgtcctaagatagtattgtgataaagacatattacagaaaagtgtgtacaatatgatcttatttatataaaattgcttatcaattcatccttctttatgtacttaagtagagaagctgtctagagggaaagttacgaaagcacttcagttgacttttaatttttttttttagttaaagccaatttttattattattattatactttaagttctagggtacatgtgcacaacatgcaggtttgttacataggtttacatgtgccacgttggtttgctgcacccatcaactcgtcatttacattaggtatttctcctaatgctatccctcccccaggcccccaccccccaacaggcccccatgtgtgatgttccctgccctatgtccaagcattctcactgttcaattcccacataagagtgagaacatgtggtgtttggttttctgtccttgtgatagtttgagaatgatggtttccagtttcatccacgtcgctgcaaaggacatgaactcatccttttttatggctgcatagcattccatggtgtatatgtaccacattttcttaatccagtctatcattgatggacatttggtttggttccaactctttgctattgtgaatagtgccacaataaagatacgtgtgcatgtgtctttatagcagcatgacttataatccttagagtatatatccagaaatgggatcactgggtcaaatggtatttctagttctagatccttgaggaatcgccacactgtcttccacaatggttgaactagtttacactcccacaaacactgtaaaaacattcctatttctccacgtcttctccagcatgtgttgtttcctgactttttaatgattgccattctaactggtgtgagatggtatctcattgtggttttgatttgcattcctctgatgagcagtgatgatgagcattttttcatgtgtctgttggctgcgtaagtgtcttcttttgagaagtgtctgttcatatcctttgcccacttttggctggggttgattttttcttggaaatttgtttaagttctttgcagattctggatattagccctttttcagatgggtaaattgcaaaaattttctcccattttgtaggttgcctgttcactctgatgatagtttcttttgcagtgcagaagccctttagtttaattagatcccatttgtctattttggcttttgttgccattgcttttggtgttttagtcatgaggcccttgcccatgcctatatcctgaatgatattgcctaggttttcttctagggtttttatgggtttaggtctaacatgtaagtctttaatccatcttgaattaatttttgtataaggtgtaaagaaggggtccagtttcagctttctacacatggctagccagtttttcgagcatcatttattaaacaggtaatcctttccccatatttgtttttgttgggtttgtcaaagatcagatggttgtagatgtgtggtgttatttctgaggcctctgttctgttctattgctcaatatatctgttttggtaccagtaccatgctgttttggttactgtagccttacagcatagtttgaagccaggtggcataatgcctccagctttgttctttttgcttaggattgtcttggcaatgcagactcttttttggttccatatgaactttaaagtagttttttccaattctgtgaagaaagtcattggtagcgtgatggggatagcattgaatctataaactaccttgggcagtatggccattttcatgatattgattcttcctatccatgagcatggaatgttcttccatttgtttgtgtcctcttttatttcactgagcagtggtttgtagctctctttgaagaggtccttcacatcctttgtaagttggattcctttgtattctctttgtaacaattgtgaatgggagttcactcatgatttggctctctgtttgtctgtttttggtgtataggaaggcttgtgatttttgcacattgattttatattgtgagactttgctgaagttgcttatcagcttaaggagattttgggctgagacagtggggttttctaaatatataatcatgtcatctgcaaacagggacaatttgacttcctcttttcctaactgaataccctttatttctttctcttgcctgatagccctggccagaacttccaacaatatgttgaataggagtggtgagagagtgcatccttgtcttgtgccagttttcagaggtaatgcttccagtttttacccattcagtatgatattggctgtggattgatcataaatagctcttattattttgagatgcattccatcaatacctagtttagttacagtttttggcatgaagggctgttgaattttgtagaaggcctttttgcatctgttgagataatcatgtggcttttgtcattggttccgtttatgtgatggattacatttattgatttgcgttatgttgaaccaggcttgcatcccagggatgaagctgacttgatcgtggtggataagctctttgatgtgctgctggattgtttgccagtattttattaaggattttcgcatcgatgttcatcagggatattcatctaaaattctgtttttttgtcatgtctctgctaggcattggtatcaggatgatgctggcctcataaaatgagttagggaggattccctctttttctattgattggaatagtttcagaaggaatggcacgagctcctctttgtaattctggtagaattccctgtgaatctgtctggtcctggacttttttttggttagcaggctatttttgcctcaatttcagagcctgttattggtctattcagagattcaacttcttcctggtttagtcttgggagggtgtatgtgtccaggaatttttccatttcttctagattttctagtttatttgtatagaggtgtttatagtattctctgacggtagtttgtatttccgtgggatgagtgatgatatcccttttatcattttttattgcgtctatttgattcttctctcttttcttcattagtcttgctagtagtctatcaattttgttgatcttttcaaaaaaccagctcctggattcattgattttttgaatcattgattttggttttttgtgtctctatctccttcagttctgctctgatattagttaaactatttcctgccttctgctagcttttgaatgtgtttgctcttgcttctctagttcttttaactgtgatattagggtgtcgattttagatctttcctgctttctcttatgggcatttagtgctataaatttccctctacacactgctttaaatgtgtcccagagattctggtacgttgtgccttttttctcattggtttcaaagaacacctttatttctgccttcatttcattatttacccactagtcattcaggagaagactgttcagtttccatgtagttgtgcagttttgagtgagtttcttaatcttgagttctaatttgattggactgtggtctgagagacagtttgttgtgatttcttttacatttgctgaggagtgctttacttccaattatgtggtcaatattagagtaagtgtgatgtggtgctaaaaagaatgtatattctgttgatttggggtggagagttctgtagatgtctattaggtctgcactgtgttcaagtcctggatatccttgttaatcttctgtgtcgctgatctgtctaatattgacagtggggtgttaaaaagtctcccattattattgtttgggagtctaggtctctttgtagctctctaaggacttgctttatgaatctgggtgctcctgtattgggtgcatatatatttaggatagttagctcttcttgttgaatggatccctttaccattatagtaatggtcttctttgtctcttttgatctttgttggtttaaagtctgttttatcagacactaggagacttttacttttttaagaaaatgtttttttctatgtgtggtttgttaaaaataagtatgaataactttccaaaatgaaataaactatctttaaatcaataaaagtaaaggaaatgaaacaacttataaagacaatgttaatgcatgggacaaggcattcctaagagaaaattagcagatgatagcattcattacatgtaagatagataaaactttgtaaaaataattagatctatagacaagagtagaaataaaaaatgaaaacagtttacttattagtatagtagaattatggtatttttcctttccatttttattgttatagtgcttaatacataagtacatatattttaaaacttcttactcatattaagccaaaatctacctccctattaagttccactgcttgatactagttttgctctctgaggccacaaagacagaagtctaattcttttagaacatgacagatctttaaatatttaaaaacctgctccccttagggcttctcgttttcaaattcctgtaggcttcataagatcaagtactatgtcttattcatctttgtattgccggcagctctgaaataatgtcttaaatatagtaggcaatcaataacattagacatttttgaactgaatatgagattcctctcattattctggtcacccttttccagatatgttttcatttgttaaaatgcttcttaaaacatggcttctagttccctcttagttcctcacactcattgtcttcaatgaccctctaaaacctactccaactatccctatggttacaaccaggtcctaagaaaccgttctacctggtaaattgagacattctactctctacttaccccatccttcgaaggtgcttgttcattcatactcactatgtctttactattgcatcaatacatttcagtcaactgactcctctaatttccaaatccattatattttttctgtcttcacatctttcctcagccctgttgatttctgagttcatacattacctttgttcttataaatatagtttaagttcccttgtcccacagtccatgcatcataagctgttgaaaaaatccaatcttgaatggatccaacctcaggatcaaaaaggcctgaagccttttccatgcctgtatccaggctgctgggtgtggctggagaaattgtaccttagagaaaactggttccattacaaatctgcagttgctgatctcaaatgattactagagctgttaacaatcctaccacactaatctcattctcatttggtaaaatttcaaaccacatcaactttcatgaaacctttaaccctctatttttccatttctctgaacctatgattgtccttcccattccacagagaaaatataaactgtacaaggcaaactctcaacttcctgccatccccgaaagtacagtatatttccaatgatacaatgacatgcaaccataatgtataccatttatgtatatgaaaaaaagacaaaaagggaaagtacaaaacaatgtttatgcttatattacaatctttttaaaacaatgaatttgcctgaatatgcacacagtttctgagggaagattaaaaactacatacagtcgcctatagggagaacttaggtaaaagggatttttcaatgtgtatactcttccataggttagaattttgaaccatgtgaaatatcttagataataaatcaaatctataaatctaatgatgtttgtttcatgctctaagttttacattatagggactaggggaggcggaaatggggtcaattatttaatgggtacagagtttcaatctgtaatgatgaaaaagttctgatgatgaaaagtggtaatggttgcacaacaacagaatgtactgaaacacattagaatgtattgaaagtcactgaattgcacatttaaaaatgtttaaatggtaaattttgttgtacatattttactgcaattgaaaaacctaaaacatatacaggcaactgtatctactgaactgtacatttaaaaatacttaaatggtaaattttgttatgcatattttactgcaattaaaaaactacaatactgataactaaaaaccaaactaccctgcaatgtcttcttattgccattatgatgaagaacaagactctgtatattatccctacctaactccgtcactatcttgaaactctcttcttttagttctagaatattcaactaggttagtatttgacttgaaaactcagtgaaggctggactatgtgggtcttgttctctaatgcatatctgatggctactacatggcttagcatgtaagaggcatcctaaaatactttcagaatgaatggataaattcaaaattaaactgtactctaaatgcagtctaatcaatgaatggagtagaagcaccccttactccaatttagcctaaggttattcaaaaccacaaatcttttagaactgaactattgataaataggtgagggtttctcaaatcccttccacacaaagctgactttctaagtctcaatgcagaatacatattctattaatatttatctaattatttttcaaacatatctctgccatccactatattaactatttctctcagattcgaaccatttgccaatggaatagacacaacctctattcagccatgggtgagaacattaaatgcaacaatgctgaggacaaaggagggacagtgcaattccatgagagacatttttttttaatttaatttaatttaggccagtcgcggtagctcacgtctataatcccagcactctgggaggccgaggcaggtggatcacgaggtcaggagatcgagaccatcctggctaacatggtgaaaccccgtctctactaaaaatacaaaaatttagccaggcatggtggcgcgcgcctgtagtcccagctacttaggaggctgaggcaagagaatcggttgaacctgggaggcggaggttgcagtgtgctgagatcgcaccactgcactccagcctgggcgacagagcaagactccatctcaaaaataaatatattttaaaaataaaaataaaaataatttaatttaattttaagttccaggatacatatgcaggatgtgcagtttgttacacaggtaaatgagtgccatgtggtttgctgtacctatcaacccatcacctaggtattaagccccgtatgcattagctatttatcctgatgctctcccttgagacatttcttgaagctgacaatgacccattaattaacaatctttaggtatgtctataaatacttttaatttgtattatcatgcagcatttttcctctcataaaaatttagacaacgaattctccttagaggtggaaatggtacaaaatatcaatgacaaataacattttaaaaattgatgaattattgtcaagatattctagacactattctgggtgacacagaatagtgtctagaatatcttaacagtaattcaaacataacattacattaacatagtaattcaacagtaattcaaacataacattaacacaccattggaagaggctgggcgctgtgcctcatgcctgtaaatcctagcattttgggaagctgaggtgggcagatggcttgaggtctggagttcgacaacagcttggccaacatggtgaaaccctgtttccactaaaaatacaaaaatttgcctggtgtggtgacacatgcctgcagtcccacctatttgcgaggctgaggcaggacaatctcttgaaccagggaagcggaggttgcagtgagcagagattgcaccactgcactccaacccaggcaaaagagcaagactctgtctcaaacaaaacaaaacaaaacaaaacaaaacaacaaaaacaaaaacataatattagggacgaccaatatgtcttctcacagcatactttttgaagacagctgctggtaacaggatgcttggctgggttatctatgtgttctctttttctatgtaaaagaatatttattaaagttgccattccctaagttttcattacttccagggggaaaaaaaaacaacataaaaggaagtgagatagagcaagccatttaaactcaccaagtgcttataaaatgacagaggggaactgggtgatctccaaagtcttttagctttaacaattgatcattcaatgtgctaatggttgacaactgagtatgttgccttctccaaatcatatttgtatttatagtttcttctaaatataaccctgtgaagtgaatgatgtaaggcattttggataagagatgttctggttgagtaatacttctgctgtctgtctcaagtcaaaccaggtagctggttacctataccctaacttctcatccctgaactacatttgcattagtacatttctgtttgtcattacttaggtatttaatacactttataaaagcaaaattatatttttgctgaagcttcacttaacttattttgaatacagtcatgacatttcaaatataaaatatgggtctagaactgaataactaaccaaaatttgcattctgcaaaattatagtgtgaaaatgacaccttcacagaatcaaaacattatggaaaaatatatagcactccacagactaacttaaaatgccaggaagtgacttgagctgagttagagtctatggaaccatagtgctttcaaggtaaagaagtaaaggaataacataaaacttctgaaatggaacctgaaagaaaatgccttttgagaagcatgatattaatcttgaaatggctttctccagaaaacagaacatgtcctccacaatcataaagcatttcacagagatgaatttttttatgaaacagggtaggcattaagtaagaaagagacaggtatactctctctttctgttgtcatatgacaagttctagtcaggaaacaaaaaaagaaatgcttattgaccacgtgggttgttccagactccaaaagataaatgcaggtaagtatgtttgttttatgtgggcaaattttaggcatttacagtctgcaacaattacaattaagggcttcccaccaatacctagcatcatgaaaaaaaaagacctatgataggaacaaaatgaatatttagaaatgacatgccaggaaccatggtttttggctataaggaactgaaactctgaatcaagattgtttaataaaaaaagaaacgttttacaacatgaataaaaggaattcagagtccaggaaggctcctggattggtcaactcttgtattccttgcaccttgtcactgtgccattaaaaagcttgcctaatctaaacccgatacccaccatggtcagaagacagctaccagaagtaggtaggacaacatgcttctttgttcatattcagcttaagatgcttatcttgtcctccatcctggaaataaagcctttcttcagcatgcttggcacaagaccaaccctagaccgttaacagttgtctgaagaatactatgtgttaactggcttagaatgaccagaatccatcagggaaaaaggatacaaagtcaacttccccagagtgctatagatatgtatatataactgaagtaaatcagaaacctgcttggaaggaagacggggtagacaactaacagtgttaactacatttgctgctgttgatttcctagtggagggaagggatattaatttgtggcactgtagcaaaatcattatagtcatttccatgcactgttaaaaaaaatcacttggtaaagactaaagagttattactttggtcaaactagcatctaaatggatttatagtttaatcaaaactgatgttagcaaattaattatgcccccagttaccagaaaaacaactaagaactgtgtcacagaactctctcagtccaagtcacaaaactatattaaattaaaattcttaatagaaagtagccaaattatactagtttttccatttttttcttttatacagaagtagtaaaataaatgtaacagtgtcagttacgtaagtactcctcttagtatttcacttaatataagaagaatccctgttttgctcatgatttttaaagtcaatatgaagaaacaaaactttgagctgggaaagattatccaaatcacttagttcagccattttattccagaagctccaaatctaaagtataagaaatgcttctccaagatgactgtgctgcgtattttttaatactatgtcaattttcagagcaattttaagttatatctgagtaaccccattagtttgacaacatctgtgaatttagcagatgaatgatgttattcatgtcaagaagttacatggatctagcatacaaaaaaaacccagatccagtattcaataattcaataaacattggatatcatgtgccaggtgccgtgttagccattgggaatagaatactggaaaaaacaagtgttctgccctcaaagagcttctagctagtaactcactccaatgaggaatacaatgcaggtcaagttccctatcaatctgatcacttgccactgcaaactggtctcttcttataaatctccagccagctgggtaatcacactatgctgaacagttaaactaacagcatgcaaagtggacaccacagtgccgcgtggcttctatagagaagtctcagagactgtcagttgggtcaggggcatcagaggctaccatgttgacaatttcaagacatccagggaaaatcagtgcgtgtgttttacacatatacattttaaaaaatacaaaagataacacaattttctgtaatttccttttctttcaacactgtatcttggaaatgagttgcatcaagattacacagtattccactgtatggaggtacaataatttacagtaagttctctacaactagttgttatccaatcatgtattatttactaaacacgcaatttcaattttgcatacatgtgcatatgtgtgtatgtgtatatctatatgttgtgtatttaataaatatgtgaataacacatgtataagaacacacatgaacaattacatacaatagtatatatgaacaagtgtaagataaacttatattttaattgctagaataaatgtatgggcttttcaatgtttggtaggtatagtgaaatttctatcaatagatggtataggccaggcagggtggctcatgactgtaattccagcacttaaggatgctgaagtgggaggatcgctgaagcccagagttccagacaaggctgggcaacatactgacaccccgtatctacaaaaaaaaattttttaattgccaggtgtggtggctcatgcctgtaatcccagcactttgggaggccagggtgggcggaacacctcaggtcaggagttcgagaacagcttcaccaatgtggtaaaacccgtctctactaaaaatacaaaaattagctgggtgtggtggtgcatgcctgtaatcccagctacttgggaggctgaggcaggagaatcgcttgaacccgggaggcagaggttgcagtgagcgtgccactgcactccagcctgggtgacacagcaagactccatctgaaaaaaaaaacaacaaaaaaaacaaagaattagccagacatggtagtgcatccctgtagtcccagctactagggagactgaggtgggaggatcacctgagccaaggcagttgaggctacactgagccatgattgtgccactgcactccaacctgggtgacaaagcaagaccctgtctcaaaaaaaacccaaaacagatggtatagccataacattcctttcaacaatgtaagacagtttgtttcttcatatgctcatgatatactgttttgttaaatgttataatttttataactgtaataggtaaaactttgtcttactgtagtttcaatttaaattcctcttatcaattagatttatgcagttaaaacctatttgtatttccttttctatcaattatttgtttacattttttgcacatctttctcagtcgctgaaattagccttctctttaattcgcaacacataaataatttttccttaattagaaattttttactttatagatattttctagaagggtgacaccttttaaattcttacacaatcaaatatattcctttttatgacttccctaaaacaaagttataaaagaattcctctatgttttatttagggttttatttaataatgtttaaatattttattcatctggaatttattgttgtgtaagaagaagggaaagaatccctgtcccttttcttttttttttttttttttaagacagagtcttgctcttgtcgcccaggctggagggcaatggcgcgatctcggctcactacaacctccgcctcctcagttctagtgattctcctgcctcagcctcctgagtagctgggattacaggtgcccgccaccacgcccagctaatttttgtatttttattagagatggggtttcaccatgttggccaaactggtctcgaactcctgacctcaggtgatctacctggcttggcctctcaaagtgctaggattacaggcgttagctactgcgcccaaccccctttttttaatactctagtttttcataactttcttggcaattgttgcttatttattttttcaaataacatttagaatcaattttctggatctacaagaaaaatattcttatttgaatatattatatctacctaagttcagaaaaaagtaaaatcttggccgggtgaggtggctcacacctgtaatcccagcaacttgggaggctaaggcaggcagatcatgaggtcaggagttcaagaccagcctggccaacatggggaaaccatgtattttttgtattttgtaaaaatacaaaaattagccgggtgtggtggcggcacgcgcctgtaatctcagctactcgggaggctgaggcaggagaattgcttgaacctaggaggtggaggttgcaatgagccaagaccgcaccattgcaccccaggctggtcaacagagtgagattccgtctcaaaaaaaacagtaaaatctttataataccaagtcttttcatcaaacaggagtatgtctttttatttatctttttatatgtcctttagtaatattcttgagtcttatatcttttatcttcattgtattttagaaatattatttgtgtagagaaagacaactgactatttattgattgattgattgattttgagatggagtcttgctctgctgcccaggctggagtgcagtggcgctatctcggctcactgaaagctccacctcccgggttcacgccactctcctgcctcagagtagctgggactacaggtgcccgccaccacacctggctaattttttttcttgttgtttcttttagtagagacggggtttcatcatgttagccaggatggtctcgatctctggatctcgtgatctgttgcgggaagtcagggaccccaaacagagggactggctgaagccacagcagaagaacataaattgtgaagacttcatggacatgtatcacttccccaatcaatactcttataatttcctatccttgtgtttactttaatctcttaatcccatcatctttgtaaactgaggatgcatgtcacgtcaggatcctgtgatgattgcattatctgcacaaattgtttgtagagcatgtgtgtttgaacaatatgaaatctgggcaccttgaaaaaagaacagggtaacagcgatgttcagggaacaagggagataaccattaggtctgactgcttgggagccaggcaggacagaactgtatttctcttattgctgaaaacgggtaagagaaatatcgctgaattctttccccagtaaggaatattaataattaacagccctgggaaaataatgcattcccagggcagggcggggggcctctaaaatggccgctctgggagtgtctgccttatgcagttgtagatagggatgaaacacgccctggtctcctgcagcgcccccaggcttactaggattaggagattccagcctggcaaattctagtcagactggttctctgctcttgaaccctgttaagatgtttatcaaagataatgggtgcacagtgggacatgaacttaatcagcaattctagtttcaccctggccttatgaccttgccctacccatttgccttgtgatattttattgcccttgaagcatgtgatctctgtgacccacagcctattcgtacactccctaccttttgaaaatcgctaataaaaacttgctggttttacggctcagggggcatcacagaacctgccaacatgtgatgtctcccccggacacccagctttaaaatttctctcttttgtactctttccctttatttctcagaccagccaacacttagggaaaatagaaaagaacctacattgaaatattgggggccggttcccccaatagtgatctgcccacctcggcctcccaaagtgctgggattataggcgtgagccaccacgcctggccgacaactgactttttaatagtaactttgtgctaggatatcttaatctattcttcttttgaacatgtttcagctgattctcagtcttccaaataaataacatcagctgtaaataatgataactttttctttcttgaaaatgtttacctcttttaatagagatggggtcttactatgttgcctaggctagtgtcaaactcctgggctcaagtgactgtcctaccttggccttccaaagtgctgggattacaggtgtgagtcactgtgcccgtcttttttctttttttttaagtaaaaaaattttttcctgacaaaattagcctcatatcctcttattgttcttttgagtaattgaattatcagttctccagagtacaggtaagctgtggtaatagtgaacatccttttctggattttagtgtttcatgtggtagtgctttgggattgaaagacacccataaacatatatacacttatatatatgtaaagacacacatatacatatataccctaaatttattaaaaactgtaatcaagggtaaatgttggctgggcatggtagctcacacctgtaatcccagcactttgggaggctgaggcaggtggatcacctgaggtcaggaattcaagaccagcctggccaatatggcgaaaccctgtctctactaaaaatccaaaaaaaaaaaaaaaaaaaaaaaaacattagcagggcatggcagcacacggctgtagtcccagctacttggaggctgaggcaggagaactgcttgaacccgggaggcagaggttgcggtgagccgtgactgtgccactgcactccagactgggcaacagagtgagactctgtctccaaaaaaaaaaaaaaaaaaacagggagggtaaatgctatattttacctaaggacttccagcacatatagagatgatgaggtttctctttgtcattattaatatggtgaattatatttatgtctttcttaatattcaactttccttgaattcctaatgtgaatgccatttgcatataatcaatatattaggtttttaatgagtttctggatttcattaatctattaatattgaggatttctgcatttgtagtctcgttttcattttttgtgctatcttgtctgattttggtattaagtgttagactgacttcatagaaacaatttagaagaattctatctttgtactttggagccctttaaaaagcatcagaaaaccatgaccatgtggtgttatttaaaggaattataaaaaaaaaatgcattgggaaacaaaacatgagagactcatatcacatataaagagattatttttgtaatatatgaagattttcagcatatcaagaaaaaagccaatacatttagtagacagaagggcaaacagcacacatagacaactgacagaaaaaaagtacaaattactcatatgtgtgaaaaaataatgctcaaatgcatttaatgacataatgggcaaatgtcacaagctactatcagttcacattggcaagaataaaataattcacatttcactatgtttgaaaagtatggaaaaagaaacaatctgacactaagctggtggaaatataaaaagctataccttccgtggagtatgatttggaaaaatctaataatataaaaatgcacatgccctttaaactagcaatttcacttctataactttatcttagatttttcccctatgcatatggcatgaaatactaaaatagctaacaattatcaagtactccctatgtatggtcactgttcaagcactttagaaatattagttaatataagtcttataataactctccaaggcaggcataataatttgccattttttttgagctgaagaaactgaggtatgaggagataaagttacttttctaaaatgaagcgttcggcaatagcagacgtgaaaataaaacacaggtggtctagctctaaatttccatgctcttcagaactataaaatactacctctcaacatgtgcaaagatattcattgctgcattgtatgcacagctatatactacaaacgtccaataagagtagactgcataaataaattctaaacagtagaatagatacagcatttaaaatgaataacaggctgggcgtggtggctcaagcctgtaatcccagcacttcgggaggtcaaggcaggcaaatcacctgaggtcaggagtttgagaccagcctggccaacatggtgaaaccccatctctagtaaaaataacaaaaattagccgggcatggttgcgcatgcctgtaatctcagctactcaggaggctgaggcaggagaattgcttgaacatcggaagcggaggttgcagtgagccgagattgtaccactgcactccatccagcctgggtaacggagcgagactccgtctgaaaaaaatatgataaaataaaataaaatgaatatcaaagctctttgagtaactgatatggaaagatctacaatacatactagacgaagaaagcaaactgcagaataatgcacaaattgtgctatatatgttgaaataaaatgaaataatattatacacatgtaatcatacatgcttgttcacccaaagggtatcttcagaaggatacacaataaagtgccaacactgcttacatgggaagggaaatggtttgctgagagacaagagtggaagaaacacttagtttttacttttgtataatttacatgtaaatctagccaataaaaataaataatttcaaaaataaaaagtagaaagtaaaaaataaaaacaaaggaaaactttgccattatctattacttttatttattttacatataggtcatccacctatatgtataatagtccaccaattatttcatagctaccacaaatttgtaaaacactggaataaagaatgattaataacctgaggtcaggagttcaagaccagcctgaccaacatggtgaaaccccatctctattaaaaatacaaaaaaattagccgggcatggtggcgcatgcctgtaatcccagctactcaggaggctaaggcagaagaatcgattgaacccaggaggcagagattgtagtgagccatgatggtgccactgcagtccagcctgggcgatgggagtgagactctgtctcaaaaaaaaaaagaatgattaataaagcaatgttcacagtaaacatgtgaggaaaaaatttacggaaaatagtttaacttacctgatgtgtgcattacagtatctttttgcatagtcggtccatcttccaaatttttgtggaaagagagcttcaatctgcataaaaagctataataatacaagtgtttgtagtatgttgtaatattttcaagtaaattattattacaatgataaaaccatttaacaaaatagtaggaagtataaaagaaaatccaactgtttattcctcaaatcccctcactactattcatcagggataaccgttatctgttgtataaatatacatttatacatctttctatgttgatataagcatatgtttatgcttttattcacataaggaggatcatatcatatatattgttacactagaattttgtcccataaaacatgtctcagacacttaaattacacgtgtctatttttagttttaaaaccttatatagacaataaaataataatgcactgcttaaaaactgaatagcaacccattatgatgtagatgtactgtaaaagatttaaacagactcgtgatattggacatataggctatttctagcttttgttttgttttgttttttgtttttgagacggagtctcgctctgtcgcccaggctggagtgcagtggcgtgatcttggctcactgcaagctccgcctccagagttcacgccattctctcgcctcagcctcccgagtagcttggagtacagacgcccaccaccatgcccggctaattttgtttttgtatttttagtagagacggggtttcaccttgttagccaggatggtctcgatcttctgacctcatgatccacccgccttggcctcccaaagtgctggaattacaggcatgagccaccacgcccagcctatttctagcttttatgaagttactaatattaacaacttcatataactgtgtgtgtatatatatatgaatatataggtatagtacatatatttatatctgtatctattaatcatctatctatccatccatccatccattcattcatccatccatttgcatttctattagaggtgatgtaggattatatttagaaatggaatagctgattctaaggtacatgctgttttaaagtttgataatgttaccatgttgcccagtaagaagattatcccaatttacactcccatcaatagtatcatgaaatcttttcatttttacagctctgataggctacacacaggactgtctcactgttattttaatatatttttaaaaaccaacagctttattgtgacatgtaattcatatactattcaaactttgaaagaacataattcagtggctttcaatagattcacatagttgtgcatcaatcatgactaattctataatatttttatcaccccccaaaaaacctccacacccattagtagtcactgcctatttctcctctcttccaatcctgccaactactaacccactttctgtttctatgaatttgcctattctgggcatttcatataaatagaattatacaatatgtagccttttgtatctggtttatttcacccagcatagtgctttcaaagttaattcatgttgtaacacatatagtattttcattcctctttaggtccaaataattccattgtacggctatatcacatttgtttatacattcgtcaactgatgggcattttacttgtttccactttttgaatatcatgaataatgctactatgtaactatacacatgagtatataatttttggtgagaatttgttttcagttctcttttttttttttttttgagacggagtctcgctctgtcgcccaggctggagtgcagtggtgcgatctcggctcactgcaagctccgcctcctgggttcacaccattctcttgcctcagcctcccgagcagctgggactacaggcgcccaccaccgcgcccggctaatttttttgtattttttcgtagagactgggtttcaccttggtcttgatctcctgacctcgtgatctgcccgcctcagcctcccaaagtgctgggatcacaggcgtgagccattgctcccggcctgttttcagttctcttgggtatatacctaagaataaaatcgctgggtcatacagtaacattttaagtaactcctaaatttttctaaagtgacttcagtgctttatatccatttaatatgacaacatattcagaaataaccaatgggccaaagaagaaatcacaaaggaaattagagaacattttgagataaaggaaattgagaacacaacataccaaaacatgagttgcagcaaaaatagtgcttagaggaaaattaatagttgcatatgactatgttaaacaagaagaactcaaatcaataacctaatttttcaccttaacacactggaaaagtaagagcaaacaacccacagcaaatagaaggaaggtcacaataaagataagagtggaaatagactgggtgtggtggctcaaaactgtaatcccagcactttaggaggctaagacgagcagatcacttgaggccaggagtttgagaccagcctggccaacatggtaaaatcccgtctctactcaaaatacaaaaatgtgccgggtgtggtggcatgcgcctgcaatcccagctactcgggaggctgaggcagaagaattgcttgaacctgggaggtagaagttgctgtgagccgagatcatgccactgcactccagcctgggcaacagagtgagactctgtctcaaaaaaaaaaaagaaaagaaaagaaagaaagaaaaaattagagaactcacacttcctaatttcaaaactccaaacttagaatttctaattttatattctttttcttagaaaaaaatcccaaacacaaattatacaatcatcaggacccacaaaattggtatttacccttgctttgaatagtggctaccacaggtgaagagtgaaaagtactgacatgtcatcagagtaggatgtaagagccactgttgtactgttaatgttctatttcttatgctcgattataagtagatgagtattcattttattattgtcatttgaaatgtatgtatcttttgtatactctcttttatttttgagacagagtctcactctgtcacccagactggagtgcaatggtgagatctcagctcactgcaacctctgcctcctgggttcaagtgattttcctgcctcagcctcccgggtagctaaactacaggcacaggccaccatgcccagctaatttttgtgtttttagtaaagatggggtttcaccatgttggccaggctggtcttgaactcctggcctcaagtgatccactcgcctcggcttcccaaagtgctgggattacaggtatgagctactgagtccagccgactctctggactcagtaggactgagtatcttgaaggatacgtttcatgattttttttaagtatatcatcacccctattattcattgacataatttgtggacataatgtcaattacgtggagctacagcactgtcagtgggcatccaagagtaaaaactataaaaggtaaaattaagcattttatcatcactatctatgtacttttatatgtatctcacaagatttccaggatagaattgaaaagcagagcttaggtaatactgttagacagggcaatgacaatagctgtcacccaggcttggctcaaaaattaatataacattggctaccatatgttgagtgcttactatgtgacaaggcatagggtgaggaactttcaaagcagtattacctttaattctcccagcaaccctacatgacagcccatgtttttctaagattcagtgttcattagtaaacagagcctccttaaacaacactaaaccttacagacatttcttccatcatgtcttcttcctaaccctttaaccattccacgtactacccatctcttagagtagcaaaagctaaatggggtatcaaacacatgccttattctttcattctaagcagataccttatctggtctgcacgtaagttttagtttctctttacttttccaaatgtgactcttaaagtgaaagaagaacagacagaagctctgaaatgcagtgtaaaagaaataaggtagattcaatcccaaccctaagaagcttataatgtaaaataggataaatgaagattaagaccatagaagaacctcaggaacacattatgaagaatattataaagttgtactaaatatggcagccttataataaaggtaaaagctatgttttatacatacctacaagcttggctaaggcttaaatgtaaatatattaaaatagccatgataaaacatacgtactatctagaaattcccaatgtactcctctagcatttaaggcatctaatttgaaattaaaaattgcaaaacaggtggttgattcaatacgcctcccaccccccttctcttcttttaagttcgaagtataaggattgtaatacctcttcaggccttcctaaagctggtgttcctgtaagaagaatggctcgtctggctttctgtactattggcaataaaatcctgctgcgagttgcatttctggatttcatgtagtgtgattcatccactataactactttgaagttctgattattcagtgcatctatcaaagtctttgcatctgcggttaagagaccataacccagaactgtcactttactggtcgacattctcctagaaaagaaaatccatgtacttaaaaaatatctcagtaatgacgttatcatgaacaatacaactctcttgggaaaaaatacagaggagaagaaagaagaatagaggaaaaataaaaggagatggtactactactgaaactctgaagatttcacaatcctcaaatataataaaccaggatccaaaatttacagttttggttaaccaaaaccaaaattttagttaaatgatctttgaaagattttgacatccagcaagccacattagtttctgacaatatttgcttctatgcacctaggatcatgcataaaatggatacttaaatattagttgactcttcaatgaaactttcacacaaataggatagcagtttttcaatccagatgctactggtattttgagcaggactaagtgaagctctgcagtgcactgaacaggccctcctgctcaaaataccagtagcagaacagacttaacagggctgttcagtgcaccgcagagcttcatttcctggtcctacctattaaaggacagtggagtccgaagcttttgtgacaacaaaaagcttcctggacctgagatgataaaatgtgaagtgtggttagaagaagcgggtaccacctcacatcaagaaccattaagctaaaatgatccctgatctttagatttctataattcatacatctgtaatattctgtatcttgctgtcaataaattattcatttacatatttatgtctcttaccatatcatgagattggtaagggcagggaatgtgtcttattcatcttttagtagtattcatacacagtgctatgatcccaaataaagtttgtagaatgaaataattagacaaataaattcaataatactaagacatatcacttttgcattttctatatcaccagaaaaaaatacaggacagagccagtcttcttcaattctctatcctctaacagaaaaggtagagctcctaagcagccagaaccactatggctactgcattttaagccctggattaatctacttaatacagagacctataattttcttttttttttttttttttttgagacagagtctcgctctgttgcccaggctggagtgcagtggcatgatcttggctcactgcaagctctgcctcccaggttaatgccattctcctgtctcagcctcccgagtagctgggactacaggtgcccatcaccacacctggctaattatttgtattttagccaggatggtctcgatcttctgaccttgtgatccgcccgccctggcctcccaaagtgctgggattacaggcgtgagccaccgtgcctggccgagacctataattttctcactgtattcaaacaccagaagagcctgaagaagaaagtaataggttatttaatattactaactaacttaggtatactgagagcaacatataggagactggcttcaaaggccactgcagcaatctgtagcttctatcctaccatgtcttgacttgtaaacagtccaggcataactgatataagccagaaggaaagtatatgtatttgtggtggacatattggtatacacctaaacctgtttctttaagtacctggaagacattgggtagtttttctgtccttaactaacatcctccaggaaacttatactctggagttgtactcctatctaacatatcccaaatactattcaaataaaaatattatccaccatttaactgcaagagtgtattttcaaaataatataaaaactagatgccctagtggctataaaagatgatagaagagtcattttaagaaaatttaaatgtgaacatttaaataaggtttatcagccaggtgcagtggctcacgcctgtaatcccagcactttgggaggctgaggtgggtggatcacctgagatcaggagtttgagaccagactgaccaacatggtgaaaccccatctctgctaaaaataaaaaaagtcagccaggtgtggtggtggtgcctgtaatcccagctactcgggaggctgaggtaggagaatcccttgaacccaggatgcagaggttgcagtgagccgacatggtgccactgcattccagcctgggcgatagagtgacactccgtctccaaaaaaaaaaaaaattaattaattaaattaaataaataaggtataccaaacagatgatggttatggaggccttaaaaaattctacattctctaaatttgtaagtcttttcaatttcattcagttttattggagaggagatttatttataataattaggataagatagcagtttttccattttaaccatgtaaatagagtccagattttcttgggcccataaagatacatgctactgaattagcatttcaaggttgaaagtgaaaaggccctccatacattttgtgtttcctccttccacattcgtaagacaactttatttttaaatataccttttatgttaacagtcttagagaatacaatacagtacaataataccaaaatttaaaaatctaagtattaacagatatttatttcagtagatgtactgtactgctttttatttaaggttcagaaatagataactttgaacctccagagacataatttgtatgaatcacctacacattccatgtaataactcatcaatactcaaactgattgtcttattctaattgctagaaagcaaaatgaggaaaaaaatactaacactataacagattttagagtgagagcttcaaataaacacaaagcaaatattttcaagatataaaatattaaaattataaataaggaaaatcaaacttactaatgagtcacacacaaaacttgcatattaattaacaaattggaaagcaaaatccactgaagttgctgataataaacgatcacaaagcttcaagtcaatcaatgaaaagttgtgagatttatttctgaaccttaagatggtttcaaatatgtttaaggtatatataaagtagatatactacatatatctttaaaagtatacgtattttacatttactttaaaaatataccataaaggaacttagaactaaaatatactattgggttttagataaataattcatattttaaaatgtaaaataaaattctccatactacttactccacttctaaattattatctattggtgatattgcattctaaaacatgaatatataccaggtacacacaaggaagacttttctccttaaatattaaacagttgttcttacctaacatcagttttattctgaataacattgatttcttctggacttagctctgggatccatttttcaatttcttctgtccaagggtacctcagagacgaagggaccactattaacagaggccattcctctttatagaagtaagtaattccaattgcctggattgtctttcctagacccatctaaattaaaaaataaataaatgttaataatagagcctaaaatattttaaaagaaaatatttatcaaacattttatttaagagtattattagctgggtgtgatggctcatgactgtaatcccagcactttgggaggctgatgcaggtggatcgcttgagcccaggagttcgagaccagcctggccaacatggtgaaaccctgtctctataaaaaaacgtacaaaaaattagctgggcgtggtaggacacacctgtagttccagctacttggaggctgaagtgggaggattgcttggacccaggaagttgacgctacagtgagcctagactgaaccactacactccagcctgggtgacagagtaaggctgtctaaaaaaaaatgtattatcaaaataattttccaatgtaaaattagttggattatacagttaataaaaagtttgagataataaggacctgtaaaattcattaagcaaatcatattatgttcaaactattcatgattgaacttaaagagacaaaattactcctaaggttaaatattatgttgattttatataattagttttataaaatgtatgtaaccatttatagtctctcctcttagactatagtaaatgtcttaacagcacaaaaccatgttatttcaaaactagagtaagtcctgaatgatgcacattttacaaaacaagcagacatagagaagttaaattatttaaatcacagctggctgatgcaaaactcgtatgagatcccaggtctcaggtgtcttcccacttgatttgtatccacactgtcacaatgcctgacttctaagctgttccaatttaaaaagtagtcacttagtgaatatttatagtgtttttgttcaaaatagccagaaactggatataactcaaatgtacttcacctgtgcatgaataatcaaatgatgtcatattcatacaatggagtactattcggtaataaaaaaagaatgaactcatgctctacacaacatgaatacatctaaaacgcatttcggtaagtgaaagaagccagattcaaaatctacatactctatgattctatttatatgtctcattctggaaagtaaaacaaaagggagccacagcagatccgtggttgccaggggctggaggtgggggaggggaatagcatgagggaacttttaggaatggagtcggtctataccttgatgttagtggctgttaacataacctatgcattttttagaactcagaattgtacactaaaaatgggtgaatttacataaaagtgtgaattatacctcaataatccttacttttttagtagttactatggcaaacaatgggaaagagagactaaaagacaggccctgtttaccagactatacaaagagaaaaaagaaaaatgcagaaactgaaaacaaagagtttaaaaatgaattttaaatgctgagcaaaactaaagaaatgagaaaagagcagattttggactttaagcaagtttccattgagaaaactttattattttgtttatgtatttttcttttaactgctcctgttaacaacaaaaaagcaatcttagaattcatgcaaagttatatttacacattcgttggataataattagtatgtttccgtgtcttcaaagccctccaattttcacacccgaagccactcaaacatcactggattctgggaacaacttggttccaatacagcagaactttaacaatcacagatcttttttttttttttttttaagacggagtttcactcttgttgcccaggctggagtgcaatagcacgatctcggctcacagcaacctccacctcccaggttcaagccattatcctgcctcagcctctggagtagctgaggtggcatgccccaccacgcctggctaattttatatttttagcagagacggggtttctccatgttggtcaggctggtctcaaactcccgacctcaggtgatccacccacctcggcctcccaaagtgctgggattgcaggcatgagccaccgcgcccggccaacaattacagatctttacctggctagagttattcagtgtgccacttccccgcctcaacaactctgccaaaaacagacttccaggaactgaggcttggccctattttttgtgtgtggacaataccactaactttgtgctatggttaggggtctttggttttgtttcctgccatggtttcataacacattttcttaatttcaatttatctggaaataggatctgttttgcttccctggttttctggaaagcagaattctctctctgcaacccagattctatcactagaacctcagcttcttgctgctaaatttacttggtgccagtcacctgtctatctatacattttgcacttcatgtatgactaacaatgttctgtgttggcttgccagacaactctctcccaaagaccgccactcctcaaaatttcctcatcttgtctactgagatcaggtatgtaagccttcaataggatacgtagaattgggacttgaaacaataggtagaattaaaaaaaaaaaaatttcagttagatagaaggaataaggtgaagagatatattgtccaacagggtaactatagttaataacaacatactacattcttaaaaattgcaaagagagtagattttaagtgttcccatcacaaaaaagcatgtgaagtaacgcatatgttaattacctcaatgtagccattctacaatgtatacatatttcaaaacaacataatgtacaccataaatatatataatttttatttgtcaaataaatatttttaaagaaaaaataagaaaaagaagttttaggttgacgacaggcgaagaaaagggaaactagcataagtatgggtaagaataagaagaatcctgatatgctgggaagtttatttgattagaagtttgaatatttttgtcttctagttctctaattctgtattcttgtatctaatctattaaatctactagaattaactccagatgttatttttcagttctaaaatgtccattagaatctgtttttgttgttgtttttgttctaacatgttaaaaattcttggggtttttttgtgtgtttgttttttagatagggtcttgctgtggctggagggcagtggcgtaatcgtggctcactgcagcctcgatctgggctcaagcaatcctcctagctcagccccctgggtagccaggactccaggcatgtgccaccatgcccagctattttttttggtactttttgggcaggctggtctcgaactcctgagctcaagcgatccacctaccttagccttccaaagtgctgggattataggtgagggccaccatgcccggcctaatagattacattctattaattacattttttacaatctattacattctttttaatagattacattctcctttgaaacgtctttttgtccacctttttgctgattttcttgatgatgttgttgttttatatttgagacagtgtcactctgtcaccaagggtgaaatgtagtggcatgatcttggctcactgcaaccacctctacctcctgggttcaagtgattctcgtgccttagcctcctgagtacctggggactacaggcgagtgccaccacgcctggctaatttttgttatttttagtagagacagggtttttgttttctttttcttgaaacggagtcttgttctgtcacccaggctggagtgcagtggcatgatctcggctcattgcaatgtctgcctcctgggttcaagcgattctcctgcctcagcctcccgagtagctgggattacaggcgcatgccaccactcccggctaacttttgtatttttagtagagacggggtttcgccatgttggccaggctggtctcaaactcctgacctcaggtgatccacccgcctcggcctcccaaagtgcttggattacaggcgtaagccactgcgccttgccaagacacggttttgccatgttgaccaggttgttctcaaactcttgacctcaagtgatctgccttcctcagcctcccaaagtgctgggattgcaggtgtgtgccaccatgcccagccaaaaaaataagttattttaaagtctctctctgataacaacatctgatctcatgtgggctctatttccttttccttttggtaccagtttttcaggatccctcatattttctaatttaacaccagatatcttgagtaaaaaattcacagaagctttgggtagtagtatcttctcccaagaggggttaggttaagttttcttagggaaggcaaattgagtaacggcaaatacctcattccttttaagacttggttttacgcttttaaagggcaagtttactcattgttgcccttattcccagcgcctgctatttattatagaagatggcccttctgggggtcaacagaagccaacgcaagatatctgtaaacaatttcttacctcaacaaggctcaaccccatctctgtctacttagtaccacaatactgctaaaatcttggcttagtttttatccttcccaactctatatttcttctaggtttcttgggatctcattctgtgcatgtatagtttaggaaatagccaaagacttaaggctaacgtgtatgcagattttctttataattctctcaagtttcctcctctctgagatttttatcttcgtatctacatgcacagtgcatagtttgggaagtagacagaatagtctctgagagaaacaagtagaagcagcctgtttgacttatgttgcttaaggcttaaggaagataaattgaatattcggtgatgaatttaggcagctgaaaaggaaaaaacaaattatgggagctaataatgtattatttttgttaggttttcaaaattctgaacattttcttcctgttcccagctatcatatcatactttcctaataacctaaaaaaatacgactgccatttaagaagtatgaaatgtaaaacattaagtaccaattaagaaatatgaagtcattttaaaaagaaaaaaaagtttctcaagtcaaacagtcttcagtataactcatgcaaggattggtcttgcaaagctgatgtgctgaatataagaataagcaatggaagcaaacagaaggataaaataaagagtctcactccattttttgatgtttacatgcaagccctcttacccttctgccccaattgtgtacaagcagatacgaaagtgtgggtgctatttcctttggcactggtgggaaatacaagctatgcaagccccggcccacatggtaagaaccctcaccttaaccccaccccataagcccaataagagactatgcctgtctcttctccttgtttttttttcaagtcatttttatatctacttgggagcctgccctcctcatcccagaaagacttgttatgtcagtaataaaccctttcataccctcttcatgtctgggtagcatcatcagcctcgacatccaaatgaaattttgagtggaaaggtccattgcatctcttcagggtgaccatgataaagggaaagccatctttcaatatacgttaataaactggcattgtgatttttataaaagagtttccttgagctttattagctagagtaaaacatctcaggatttgatcaacttgctgtcactgaaaataataaatttcttggttgggtacagtagatcacatctgtaatcccaacattttgggaggccgaggcagcaggactgcttgaggccaggagttcaagaccagtttgggcaacagagagagactctgtctctatagaaaaatttagtaatccccaggtgtggtggcatgtgcctacagtccaactaatggggaagctgaggtgggaggactgcttgagtccagaaggttgaagctgtagtgtgccattaccacgtcactgcactccagcctgggtgacagaatgagaccctgaaaaaaaaaaaaaggaaacaaagaaaagaaaaaagaaaagaaaagaaaagaaaggagaagaaaagaagaaaagaaaatttcttaatctacccatttcctaatctacttgaagatcataccctatggtattaggactgacactgacactcagtttttgtccagctatctttcctggtaagaacccccaacttcttattcagcatctctttagtttaaagattatgtagtgaaatgactaaaagtgattctcagaaattagaaagatatttatcaatacaaagtgaaacatttgggtactatttttcttaggtatttgtttttggttgttcatttttgggacatggtgaggtaggaaataaagtttgatgaaacaaactagaaaaatacatagttctaaattagaaaataaaagtatattggcataatctcatattcccattaaagaaaggaataatacatagaatgactcagttctaaataaaatttgaaaaggactaccttttaaaataaacttttaaggccaggaacagtggctcacacctgtaatcccagcactttgggaggctgaggcgggtgggtcacctgaggtcaggagttcgagactagcctggccaaaatgatgaaaccccgtctctatgaaaaatacaaaaaaattagcccggcatagtggcgcacacctgtagtcccagctactcgggaggctgaggcaggagaattgcttgaacaggggaggcggaggttgcagtgagctgagatcatgcgtttgtactccagcctgggcgacaagagtgaaactccacctcaaaaataaagaaatgaataaatagataaaacaaaataaactttggctgggcacggtggctcatgcctgtatcccagcactttgggaggccaaggtgggcggatcacaaggtcaggagatcgagaccatcctggctaacacggtgaaaccccatctccactaaaaatacaaaaaattagccaagcgtggtggtgagcacctgtagtcccagctacttgggaggctgaggcaggagaatggcgtgaacccgggaagcggagcttgcagtgagcggagattgtgccactgcactcctgcctgggtgacacagtgagactccgtctcaaaaaaataaaataaaataaaataaaaaataaacttttaaaacatgtacttagattttcagtttttgtttttattttgagacaggctctcactgtcacccaggttggagtgctgtggcctggcctgatcacagctcactgcaacctcaaactcctgggctcaagcggttctcccacctcagcctcctgagtagctgagactacaggtgcacaccaccatgcctgtttttggtttgtttgtttgtttgtttgtttgtagagatgggggggtctcactttgttgtccaggcttgtcttgaactcctggctcaaccaatcctcctgccttggcctcccaaagtgctgagattacaggcgtgagccaccgcacttggccagatttcagtattttgaaaagaattgaaaacagcatagcattcaattataaaagcaacaacacacttcaagtaatttaggcatacaggaataactacactcaacatgtggttcaaagccctgggctctaacaacaatagaatttgttaatgtggaactcttcagtgtttcatcaccattaaggctaaatcaatgattaagaatcaaagtcttgaataaacaatagtacaaatgtccaggtagctacataagaattaaatagaatacattaacctcaagaacacatttcatcaatgttttcaaaattgtaaatcaccattttacttaggagaataattttaggtttcctaaatgttttattctatgaaattattaagagcaattaaataacaattatcctgatacataaaatttcagtttcacttttttatactgtgattacttttataaagcaatttttatttctatgcattaaaaatgctcattgacatttttcgaaactaaaaacttttccggttttaatgttataagcagcttgttcctttgaaggcagataggtaggtttgtctttaaaataggtggcctgtttgttataaaagagattgctttggaggacccttttaggtatgcttttaaaatcttagtgaggatttcaattaagaaagaaaacccgcataaagaaatagcagactgaaatactatgttctgttacttattattaagggggtatatattttagcagaaccactttcttgttcttgtacattgttagtgctatttccaatagagaattttagatggtacacgtgattatttgttcttagaattgtgtgtgtacggccgggcacagtggctcacgtctgtaatcccagcactttgggaggccaaggcaggtggatcatgaggtcagaagatggagaccatcttgactaacacagtgaaaccttatctctacttaaaatacaaacaattagccgggcatggtggcggacacctgtagtcccagctactcgggaggctgaggcaggagaatggcatgaacctgggaggcggagcttgcagtgagctgagatcgcgccactgcactccagcctgggcagcagagcaagactccgtctcaaaaaaaaaaaaaaaaagaatagaatagtgtgtgtacatttcaattctgtcttcttttctcataagggactaggaaaagagaacagaccatatgggtatgcacatagccctgatcttcttcttactcaagacagaagagtctatgctttgggaactgtgctatcactttcctgatggttggttggtacttgtgtgcaggagcaggctttctcttgaagggaatgcactgggaacagaggaaggcagaaaggagatgggccttagagagcagcaggatgagaggaaaaaaacttatttatctaaagggagggcactgagtcggggatggtggcagaacttaagtagagttgtagtccaaagcatggcttagagatgcccatattgggactagaaaaagaaaatcagggagaaggctctggaatggtctgagaggctggatataagcaaatatatgcccctttttattttttttcctagacatgggtctctctatgttactcaggctggcctcaaattcctaggctcaagcaatcctctggcctcagcctccagagtacctaggattacaggtgcacaccactgtgccccacttgagcaaacgtgttttaagaatagacatttctagtggcagttagatgttatgcttttaatgtggtatttttatcctcctccagtctctagtaaagttttattcaaagtcacagctttacaaatggaataaaatgtcatcaactgataaatctgagtaaagggtatatggatgatctttgtattatttatgttcctgaaacccttctgtaagtatgaaatgactttcaagtaaaaagattaaaaaaaaagttacagctctacaacgtagtagcagtcgtgcttggtggaaggaaaagagggctgttctacacttcaaaagtagtagacaaaaagaagtgataatctatatcacacagtgccaaaagaagcaaaatttctaaattcttattcatttatttgagacaggatctcgcactgttgcccaggctggagtgcagtggcatgatcatagttcattgtaacctcaaactcctggctcaagtgatcttcctgcctcagcctcccaagtagctgggactacaggcaagcatcacctcacccagctcatatttaatcttaaagagtcacaagacagtaaaaaatgagatacttaactataatgggaactgctcacatgcatatgtattattcattcaacagtaccattcctcagataaaatttgaagttcagaaataaattttccataatttttgtacgttttaaatctgttttgtaaaattaaaaccaagttaacaaacttaattaagattctagtcatttttttccacttgcattgtagtataggagcctcagcaatttcttaaaattgagagcccaacacagcacaaagaaaataactacaagtgcttgggtagggtagggagaaagaaaaggaaaggacaaaaagaaatggggggaaaaagtccaatctcccagttatgctctaagttcttacaatctattatacctaggcatcatttagatacatgttaaaaattcagacttcaggacaacacctcaaattctgattcaatagaaatggacttttaaaataaaaatccctttgggaggctgatatgtgaggattgtctgatgccaggatttttgagatcagcctgggcaatatagagagaccacatctctacaaaaaatacaaaaatttgctgatgtgctggcatgtgcctgtagtcataactactggggaggctgagctaggaggattgtttgaggccaggacactgcacttcagcctgagtgaaacagcaagaactcgtctctaaaaataaaagaaatgaaggaaggagggaaggagggcaggaaggaaggagggcaggagggaaggagggaaggaagaagggaaggaaggagggagggaaggaaggaaggaaggggcaagcaaaaatgattcttatgtggatgactctcaggttgcattttgagaataactactataatgattaaactttgggaaaaaaatcttagctttgcctaatttttggccatttcctcatcaggagaaacaaacagataaaaacacgaaaaacacttccatgatttgattcttgaacttttaaatcatttctggggtatctggtttcttgactgacctttaattacaattccaaggcagtataaacatagtgctttctaccctgctatatagtatgtagaataaatttatctaaaacagaatttggggctgagcacagtggctcacacctgtaatcctagcactttgggaggctgaggtgggcggataacttgaggtcaagagtttaagaccagcctggccaacatggtgaaaccccacctttactaaaaatacaaaaattaggccaggtgtggtggctcatgcctgtaatcctagctactcaggggggttgaggcaggagaaatcgcttgagccctgggaggcgaaggttgcagtgagctgagattgcaccactgctctccagcctaggctatgacagagagagaccctgtcacaaaaaaataaataaggccaggcacggtggctaacgcctgtaatcccatcactttgggaggccgaggcgggcagatcacgaggtcaggagttcgagaccagcctggccaatatggtgaaaccccgtctctactaaaaatacaaaaattagccgggcgtggtggcacacacctgtagccccagctactcgggaggctgaggcagaagaatcgcttgaacctggaaggcagaggttgcagtgaacagagatggtgccactgcactccagcctgggcaacagagactctgtctcaaaaaaaaaaataaataaaatgaaataaaaataaataataaataaatgaaaaataaaaatacaaatataaaagttagccaggtgtggtggcgggcaactataattccagctacttgggaggctgaggcaggggaattgctttaacccaggaggcagtggttgcagtaagtcaggattgcaccactgcactccagcctgggtgacagaccaagattctgtctcaaaaaacaaaacaaaaacgaaatttggcttttcacttcacaatctacttgaattagctagcaattttatagaaaaagactaatttcagaagtttaataaaggcactgaaagggtatctaatttgcaccttgctttgattatatatctcaggtaatcaattaaagtgctatatataaggctcaatgatcaaccttaactgtttaacaaattggaagaacaataacttgcatcactaaaatttctatacgtaatgaacacagtgaaaatataacatattcttaaaaaaagtgtatgaaaaatactaaattttctatgttgtttactaacactgaatttgttgatcacaaatgtaaacaaaagggtgtttcaaaacacatgaagataaggattaggaaacaaagagcagataagaagcatttgcacttggcaaacttgattactgccattaaggaccatagataagttcagttggagattttataaaaggaagatgaataaatcccttgcttagtatcataaataattacagcgtgatgctttatatcctttttaatgtggcaacactataattaatttgaagacatcataattagaaaataaagaaccctgtattgaaattcagactagtatattaaaatactatgttctgcagttacataatgacacataaaattatggtggaagtaaaataaataaataaagacaccacttatttgtaacaaagggaaaattatttctgcttttaaaataaggaatcaaaagcacatccatcaacagcttgagacaaaatttttgcaggttattaggatgctttcggttgaacaagtacttggattaatctgtcaattcatgtgttgacacatagcaatcacttcagaataaaccattagaaagaattccaaatctcaactaggtaatttttggaaatgttaattaaacaatgatggagattccctactcagattcagaacgtacacccttttaagatgggtctcgtatatattaaaaagagggagaaagaaaggacgcctttgtgaaagttttttttttaagaaaagtacaaattaacttacctaatggttactaaatcgttacataaaatgaaaaaggaaataagcaagaggaaaacaaaatgctggttaatcacatcctctgccagttgccaaaatacaacaattgactaaaaattgagccctaatgagttgagtagtttcaaaagttaaaacataaaggaaggccactgaatactgagattaggctgggtattatgtgcagaaatgaaaacaagaatatgaatcaaatgagacagcaaaatcaatttgttattctaagaaagacatggaatgttacaagtaaaatttgctgtttaaattgagttaggcaataaaagaaaaaaaaaggactactaagaaaaagaaagagaaaactatcaattcttgtaagtatttattatttaaaaattaatttttaggccgggcgtggtggctcacgcctgtaatcccagcactttgggagaccgaggtgggtggatcacgaggtcaggagatcgagaccatcctgtctaacacagtgaaacctcgtctctactaaaaataaaaaaaaaaattagctgggcaaggtggcaggcgcctgtagtcccagctattcaggaggctgaggcaggagaatggcgtcaacccgggaggcagagcttgcagtgagcagagatcatgccattgcactccagcctgggcgacagagcgagactccatctcaaaaaataataataataatttttatatatttaaagaacgttggcaccaatgatttttactctaaaaaccactccaactctgctttgtaaaaatggccgtgcaaatatgtgctaattaccttgatatttgcaagttggtgctcagaattcatactttaggacaggaggctctggagtggtggcccatagtgtgatctcttggacctgtatggtaagaacctcagtttatagtgtttaaaactcagatctgtgtaaaaatgtgactcctggcttctctcaacaactcaggactggtggcagccacgtccccgtgtagacagtggactggaggcggggactgctccttagctggggtcctctcatcccagtgtgcccatgtccctgcgaggacttcactccctggaggccctgtctgtatctgcttttgggatgcctgccttaaggattgatgtcaagtctttataaacaatcactgtgtgtgtgtttgtgtttgagagtgcgtacatgaacaagagagagaaaaccaaaaatcacaaatctggaaaagttaataaagatctagaacctaaaaaaaataaataaataaataaaccaccccattgtcaaggtagagtttcctgggtctaaaccatatggttttcttctctacggtagcatctacataaattgtttctgcattaaacatagtgatagataacttttccctataatgcaatgtcaccatgatctccagggtagtactatgacaaggtgaaaaatattcagtttctgacatttttattggatagagatgtcccttgttttcccaatataactaaatatattattgaataacttctcttttactcaatagcatgaattaactgagaagttattcaataatgtttattagttataataaccaataataacaggttattattgaataacttctctgttcttttgtcttctagtagaattagtaatagctccaaatttcttaaatgaatctatacatagaatatactcaaaagagcacagtctgtcaattattacttaaggaattcacttttaatctataaaaagaaatgagatgtcaaaactgataatgtcatcacatgctagtcacattcctaatttattaaatattattcatgtcaaaattttaaaatgactttaattttgtagaatcagttgataagagaaaatgcaatacataatgaacttcagaaaagttaatgagaaggttatctaaaaatatcttcctaagaaaaaaatttcaaattgggttaagagtcaaaataaatgttatttgctatgtactaataactacaacaataaacaataaataatgaaagttagtttttaggagaaaatgaatatgttaagaccaaatctgggcttgattttattttactgaaatattagtggcattaaaagcagtgaaaatagttcattaaattcatggttaacatcatgtcataaactaataagttaaaataaaataacaaaatattatgaaaatgttgaaataaagtagtaaatggtaggaatcaatattgaaataaaaaagtaagatagctgggtgactgtagttaataataatttaattgtacatttgaaaataactacgagtataattggattgttgcaacacaaaggataaatgcttgaggagatggataccccatttaccttaatgtgattattacacattgtatgcctgtatcaaaatatcttatataccccataaatatatacatctactatgtacccacaaaaattaaaaattaaaaaaagacagctaactcaatccatgaattaatgatctattataaaataacctaaaacgtaaatttcaaataaaaatgtactgaaaaatagcagaaaatttcagcagacagcatttactcgtcttttctaatattatttatcaataatagcctcaataccaacattaacaaaaatagataaagagtcatttcattttgcctgtaaactcacttaggacagagaagaaaaaggctttggaggggtgaaaataaaaaataagatgcagacacataacttaaaacactctattagattaagtaaagggcctaacttgtctcagtagttgataactttgagtaacaaaaaaggttaaattatgttcagagtacaatgtttaaaaaaacagaaatacatagaaagtatttgaaaaaaatgtttctttcaaaactgttacggtaaaaaaaaaaatggaatgcctggctatcctaaaaactctgactctctagaaatatctcatttcctatgggcttaaatatataaaatttcaaaacagtaaaacattgccatcattacaaatatattttattaatagtttgtttctaaattaatgtttaaaaaattgaaagcagtatgagaagattagaacctgcagaaaatgtcaaagattaaatcattctactgaaaacttctgaaccactgatgagtaaaattagataaaggttaagagaaagagacacactttgcctcactataatatataagaagaggacacgaagctaagaatcaagaaaagtcaatcttacacttgtttttttaaagcaatgcaagttttttacaaataaaatattatacagaaactcaacatttgtaaagccgaaaaagtgagaccactatagccgaagtaaggtggggacctcatagtcccataccctcagtctcaacctcagttctgtgaaagacagttctgtgaaacagggcttgcaaatcattgagggttgctcagtcaataaactcctcaattttcgttttttcaatgctggttttctacttatttcttttacaagacccacttccaatctacctcctccacaaacccttccaacttaatcaatatgaaattaatggttccttccacaatagtatcatagactttatattgtaaacttcacttccaatatttccagtaccctacattttacagataccacacagagctatacacccccactcatccttacttgattagagggagggcatgtttctttttttttttttttttttaatatcctcgaagatctttatctatacacatacagataaatagctataattttgtgtgttttgagggacgtggcttaaacaaaaacaagctcattttttacctattgttctataatctttttttttttaacttttttatttccataggttactggagaacaggtagtgtttggttatatgagtaagttctttagtggtgatttgtgagattttggtgcacccatcacccaagcagtatactctgcacccagttttagtcttttatccttcacccgcttcccaccctttccccgagtccccaaagtccattgtgtcattcttatgccactgcatcctcatagcttagctctcagttatgagtgagaacatatgatgtttggttttccattcttgagttacttcactcagaattaatagtctccaatatcatccaggttgctgcgaatgaaggcatgtttcttaatccatagttctaagaacttaccaaacagaagactcaataatatttatttgttgcatacaggagtaaaagttagattaatcaatggatacaggaaaaaaatggctttaaaatgtttcagtacaaagagttaagacttgtattgataaccatccctagctactctacatgaaaagttgggagcctttatgtatattctcagttgtccaattcccaatacagatgtgggaagaggcccattgatgtgatttggctctgtgtccccacccaaatctcaccttgaattgtaataatctgcatgtgccaagggtgggaccaggtggaggtaactggctcatggtgggggtttccctcatgctgttcgcatgataatgagtgaatctcatgagatctgatggttttataagcatctggcatttcccctgcttgcactcattctctctctcctgccaccctgtgaagaggtgccttctgccataaccttaagcttcttgaggcctctccagccatgtggaactgtgagtcaattaaacctcttttatacattgcccagtctcaggtatttctttacagcagcatgagaatgaactaacacaccaataaagttgtggcctctttggatttttaagttctgtcaaaatttaagctcattactcaaaaaggaaaaggaggttacagggtgggatttaattttaaccattcttcccatttttaaacaactgctagtcataaagaacatttcacttaataaaaactggtatggtaggaatgtttgcaacattttctttacgatgcacttggaggtgttaatgtattaatataataacaatacttagggtgagatgatgctattagtgctttgtgcttttcaaatgctgatgtgaacttaaacattaaattccaggaggatgctttgtgtctgtatctatctgggtatggtttaactcaccatcactgccacctctgcttttcatttcgaattttgtctaagactattgagagaataccacaataacccagttgtgcaaaacagcaggagctctcaacaaaattacatcagcttccaaagaaatcaggacagacttctttaaaattgaagatgcaatcaattgcatttgtactctgctagtggtcaagataaatttttaggctgagaaatgacttaaacttatttagaaaaccaagaatactctatgctagacattttaataaagtttttgaaaagattcctgtcaagggctgaatgttttttctccaaaaaattcatgttaaaatctctaaccctgaatgtatcaggaggtggaggtggaggcttttggagggaagtcataagggtggggccctcatgaaccagatcagtgtccttttaaaagagacttcagcccacgcacggtggctcacacctgtaattctaacactttgggaggccaaggcaggcagaacacttaaggccaggagttcaagaccaaccatggtgaaaccccatgtctactaaaactacaaaaattagccaggtgtggtggcaggtgcctgtaatcccaactactcgggaggctgaggcacgagaatcacctgaacctgggaagcagagactgcagtgagccaagatggtgccactgtgccagcctgggtgacagagcaagactctgtctcaaaaaaaaaaaaaaaaagagacacagagaaacttaagacttcagaaagcaatctcaccccttctgccatgtgacacatcaagaagatggatgtctataaaccatcagatactgaatccgttggcgccttgatcttagacttcccagcccccagaactgtgagaaatacatatttgttttttaagccacctgtctattgtatttttgttataggagtcagatgggatcaagacaatccccaaacccacttaaaggaatatctgctactttatctccatgcttaggataactggaggtgggtggtagaaggcatggatctaatttaaagcactggttaaaaggccaggtgctggccaggcgcggtggctcatgcctgtaatcccagcactttgggaggcggatcatgagatcaggagatcgagaccatcctggctaacatggtgaaacccgtctctactaaaaatacaaaaaaatttgttgggcgtggtggtgggtgcctgtagtcccagctactcaggaggctgaggcaggagaatggtgtgaacccgggaggcggagcttgcagtaagccaagattgcgccactgcactccagcctgggcgacagagcgagactccatctcaaaaaaaaaaaaaaaaaagccaggtgcagtggatcacacggataatcctagcactttgggaggccaaggcaggattgcttaggctaggagtttgagaccagcctgggcaacacagtggaccctgtctctaaaaaaaaattaaaaaattagcctgatgtggtgacatacacctgtagtcctagctacttgggaggctaaggcaggaggattgcttgagcccaggagttcaaggctgtattccagcctaggcgacaaaagcgagactccatctcgaaaaaaaaaaaaaaagcactggttactgatagacaagacctccatttgtctaggtgatgagatcttttcttttttctgactagttcaagtgatcttaagtcaacataaagaataaattaataaaaattcattcatttgttcaggagacattaactagaaatacattctcaggcactgtggtaagtacatatggctcctaggagttccaatctgtggagaaaaccagacaagtacggtaggatatgattcaaactacagcagaagtgagagcagacaggaaccaaaaggcaaccagagatggcaatatagaggtagtgatatctgaagaatgttttgaaggattactttttagatagacttgagaaaaatatgagacacagaagaaggaaaggaattaatcagagaaagaactacacagaaatagtaaagcataaaaagtcatgatgggctgggtgcagtggctcacacctgtaactgtagtactttgggaggccgaggcaggcggaccacttgaggccaggagttcgagacaagcctggccaacatggcaaaaccccgtctcaactaaaaatacaaaaattagctgggtgtaatggtgcatgcctgtaatcccagctactcgggaggctgaggcataagaatcgcttgaacacaggagacggaggttgcagtgaaccgagactgccccactgcaatccagcctgggtaagactcttgtcaaaaaaaagaaaagaaaagaaagaggggaggggaggggacgggaggggaaagagaaagaaagaaggtcatggtgtttgaaaacaaaagaaaaagagcaagaaaactaacatttgttgggtatatgagacatattcttcctatgctttacataagcaatccaatggcaaaagtattattattgcctactttaaacaagagataattgaagctgagagatcaattaactggtccagtgtgatgtaaacagtaattggtaaagattacaacaaatagatggaactgtctctagaatttctgccagagaatagcagaagaaaatggaagaaacaggtagtggctagcttgtgaagtgctttactctatcggcctgtaatctcagcactttgaaaggccaaggtgggcggatcacctgaggtcaggattttgagaccacactagcgaacatgcgaaatcccgtctttactaaaaatacaaaaattagctgggtgtggtggccagttcctgtaatcccagctactcaggagactgaggcaggagaactgcttgaacccaggattgggaggctgcagtgagctgagatcacgccactacactccagcctgggcgacagagcaagactacactaaacaaactaaactaaactaaacttctgctctgtgaaagacaatgttaagagaatgaaaagacaagccacagactggaagaaaatattaaaacatatctttttttttttttttttgagatggagtttcgctcttgttgtccaggctggagtgcaatggcgtaatcatagctcacagcaatctctgcttcccaggttcaagcaattctcctgcctcagcctcctgagtaactgggattagaggcacctcccaccacacctgcctaatttttgtatttttggtagagatggggtttcaccatgttggccaggctggtctcaaactcttgacctcaggtgatctggccgccttggcctcccaaagtgctgagattataggagtgagccaccgtgcccgacctaaaacatatctaataaagacttgtacttaaaatatacaaataactcttaaaactcaacaacaaaaaaagaaacgatttaaacatgggtataagatctgaacagagacctcacctaagaagatatgcagatggcagataagcatatgaaaagatcctcaacaacataggtgaatagagaattacaaatgaaaatgagatactactacacatacattagaatagctaaaagaaaaatgataataccaacggctagtgaggatgcagagcaagcggaactctctttcactgctaatggaaatggaaaatggtatagctaatacaaaagacacttcgacagtttctgttaaaaaaatatggtcttggccgggtgcagtggctcacgcttgccacattcttcaaaactgaagaatgtattgaaggattactttttaggtagacttgagaaaaatatgagacacagaaggaaaggaattaatcagagaaagaacgcttgcagtcccagcactttgggaggccaaggcaggtggatcacctgaggtcgggagttcgagaccagcctgaccaacatggggaaaccccatctctactaaaaacacaaagtggccgggcacggtggctcactcctgtaatcccaccactttgggaggccaaggcgggcagatcacgagctcaggagattaagaccatcctggctaacatggtgaaaccccgtctctactaaaaatacaaaaaactagccgggcatggtggcgggcaccagtagtcccagctacttgggaggctgaggcaggaaaatggcgtgaacctgggaggcggagcttgcagtgagccgagattgtgccactgcactccagcctgggcgacagagcgagactccatctcaaaaaaaaaaaaacccacaaagttggccggggtggtggagcatgcctgtaatcccagctacttgggagtctgaggcaggagaatcgcttgaaccccgggagacggaggttgtggtcagccaagattatgccactgcacgccagcctgggcaacaagagcgaaactccatctcaaaaaaaaaaaaatattgtcttaccatatgttatgggttgaattgggtaactctctcccaaaagatatattgaagttctaacctctagtatttcaggatatgaaattatttatttaaaaataggtttgctgcagacataaatagctaaaatgaggtcatattagagtaaccttaattcaatctgaccagtgtccctataagggaagaggcatagacactctgggagaatggcgtgtgaagacagaggcagacaatacagtgatgcatctacaaatcaaggattgctggccttcactggcaagtaggacaaaggcatggaacagattatccctcggaaacatcagaagaaacctaccctgttgacacctatttcagacttctagcctcgagctatgagagtaaaaatttcaattattttaagccccccagtttgtggtactatcttatggcagccctaggaaactagcacactatatgatctagcagtttcacactcctagatttgaaaacctatgttgacacaaaaacctacatgtgaatatgtacagcagctttattgtcaaaaactggaagcaatcaagatgtctcttcatctttgtgaacgaaaaaacgaactgtggtacatccatacaatgcaatataaatcagtgataaaaagaaaaggctatcaagctacaaaaagacacggatgaattttaaatgcatattgctaagttaataaagctggtctgtaaatatcatacatataggattctaattatatgatattctggaaaaggcaaaactatgaaattgttaaaaatatcagtggttaccaggggttcagccctgggggaaattgaataaatgaggcacaagggattgtgtagggtagtgaaactgtcctgtatgatactataatgatgaatacaagacattaagcatttgtgaaaatccattgaactttatcgcataaagagtaaacctgaatgtacgcaaatattttaaaaataaccgaggagggcaaagataccaggatggaaaacaaaatgtgataaaagaatgtatatgtattacaaatgtctgaaatatcctcactggaggatgtgggggaataaggtgctgacctgagtaacattggaaatgaatggagtctataagaataaagtcaaaaggaactgtacattacaccatgctctagccaataaagttctttcccatggaggtacaggttaacaactgtgaaactgctattcatgtatactggaaatcagcaattaagtaaacagatggcagatggtgggacccactgttagggttaaagattacagatacttaatgtgtgtgcatagcaatgtgtgtgtacagcatctgcaaaccaaggaatgtcaaggattcctggccttcacaccctgctatacatgtacatatatatgtatatctatgtataaatacacacacaagttagtatatataatctccttgctctataagctgatagaacctagaaggacacccctggagaaatggagcacccaggtcctcattctagtatcgatcttcagtaaaatgaaattagtttttttttgaaaaatgactgattctagactgggacaagaaatgcatagatgagcctgaagcatcctgtagtaccagaaagtaagaaaatgctcaaaaacccaaaccaaaacaaaaaacttctaaaatgaaggggttatgtcaaagggacacaggagtgggttcccaattgccaaagctgaaacaatttgagcaacaagataaagaaagtagtaatgaattttaactcaaagtatacaattaatatccatgagtccacactgatacaaatacatgattaagtaaataaatgaatgaatgaattccaaataatttatgtatttactccagctttgtgatggttaatactcagtgtcaacttcattggactgaaggatacaaagtattgatcctgggtgtctctgtgaaggtgttgccaaaggatattaacatttgagttagcaggctgacaaaggcagacctacccttaatctggttgggcacaatataatcagctgccatggtggctagaatataagcaggcagaaaaatgtgagaagagagactggcctagcctcccagcctgtatctttctgctgtgctagatgcttcctgccctggaacattggactcccaagttcttcagttgtggaactagaactggcttccttgttcctcagcctgctgatggcccattgtgggaccttgtgatcatgtgagttaatacttaataaactcccctttatatatgtatctatcctattagttctgtccctctagagaaccctgactaactcaagtttaagaaagtaaaatacatccaggcacagtggctgacacctgtaatcccagcactttgggaggctgaagcaggcggatcacttgaggtcaggagttcaagaccagactgaccaacatggcgaaagccggtctctactaaaaatacaaagattagccaggtgtagtggtgggtgcctgtaatcccaactactcaggaggctgaggcaggagaattgcttgaacccgggagacagaggttgcagtggccgagatcacgccattgcattccatcctgggtgacagagtgagactccatctcaaaaaaaaaaacaaaacaaaaacgtaaaacacaactctccattcctaaagtatgggctgtgaatagttactttcttcccaaaaattcagtataaaaaaagggggggaaatgagtaactatacagtaacaaaacctggcaaacactaccttaagccaggtgattgggattaacattaacagtgataaatcatattgatagtatgcatactttgtatgatgtgatgacaatagcacttcacctctatggtcttcccccaaaaaacatattccccaagtataaccacaaggaaagtaccagttgaattccaattaagggacatgctacaaactacctaaccactaattttcagaactgtaaaggtcttcaaaaacaaacagtgtgtgagaaattgttacaacccagagaagcctaaagagacattgctaatatgcagagtaatgtgtttcctggatggaatcctagttttatttttatttatatattttttaaaaggacatgagagaaaaactgagaaaacctgcataaagtatggtcttcagttaataataatatatgaatattggctcattaattgagacaaatgtaccatactaatctaagatatcaataataggggaaactgggtgtggggtatacaggaactctgtaatatctttgtaataattctataaatctaaaattgtattaaattaaaaatttttttaaaagagcacattcaaaaataataaagttggacttagaaacaaggaagtaagcaggcaggtgacactgatttaaaggactaccgtgtagtctcaccaacacacacttttaatgctatcaccttcattctaacttcactgtcttattcctttgagccctatgtcttccaaattcttctgtcctcaagaatactgtctcaaaaatagaaagtctggtacctggggactgtaatgtaattgacagtgagagttggagctgaatcactccaattatttcacttgaggtcaaatatcaggtcccggcatcttctagttatatgtccttgggcaatttaattaacccagaatttcatatccggccaaactaagcttcacaagtgaaggagaaataaaatcctttacagacaagcaaatgctgagagattttgtcaccaccaggcctgccttacaacacctactgaaggaagcactaaacatggaaagaatcaaccggtaccagtcactgcaaaaacacaccaaattgtaaagaccatcaatgctatgaagaaactacatcaattaacaggcaaaacaaccagctaacatcataatgacaggatcaaatgcacacataacaatattaaccttaaatgtaaatgggcgaaatgtacccattaaaagacagaaactggcaaattggataaagagtcaagacccatcagtgtgctgtattcaagagacccatctgatgtgcaaagacacacataagctccaaataaagggatggaggaagatctaccaagcaaatggaaagcaaaaaaaaagcaggggttgcaatcatagtctctgataaaacagactttaagccaacaaagatcaaaagagtcaaagaaggccattacataatggtaaagggatcaattcaacaagaagacttaactatcctaaatatacatgcacccaatataggagcacccagattcacaaagcaagttctcagagacctacaaagagacttagactcccacaaaataataatgggagacttttaaaaccccactcacaatattagacagatcagcaagacagaaggttaacaaggatatccaggacttgaagacagctctgcaccaagcggacctaatagacatctacagaactctccaccccaaatcaacagaatatacattcttctcagcatcacatcgcacttattctaaaattgactacataattggaagtaaagcactcctcagcaaatgtaaaagaacagaaatcacaataaactgtctctcagaccacagtgcaatcaaattagaattcaggattaagacactcactcaaaacttcacaactacatggaaactgaacaacctgctcctgaatgactactggttaaatagtgaaataaaggcagaaataaagatgttatttgaaaccaatgagaaaaaagacacaacgtaccagaatctctgggacacatttaaagcagtgtgtagagggaaatttatagtactaaatgcccttaagagaaagcaggaaagatctaaaattgacacgctaacatcacaagcaaaagaaccagagaagcaagagcaaacaaattcaaaagctagcagaaggcaagaaataactaagatcagagcagcactgaaggagacagaaacacaaaacacccttcaaaaaatcagttaagggcggttccaagatggccaaataggaacagctccagtctacagcccctagcatgagcgacgcagaagaggggtgatttctgcatttccaactgaggtactgggttcatctcactggggattgtgggacagtgggtgcaggacagaggatgcagtgcattgagcgtgagcctaagcagggtaaggcatcacctcacctggaagcgtaagggatcagggaattccctttcctagccaagggaagggggtacaaatggcacctggaaaattgggtcactcccaccctaatactgtgcttttctgaccgtcatagcaaacggcacaccaggagattatatcccatgcctggctcgcagggtcctacgcccacggagcctagctgattgctagcacagcagtctgagatcgaactgtaacacagcagcaaggctgggggaggagcgtccgccattgctgaggcttgagtaggtaaacaaagcggcctggaagctcgaacagggcggagcccacggcagttcaatgaggtctgcctgcctctgtagactccacctctgtgggcactgcatagccgaacaaaaggcagcagaaacctctggagacttaaatgtccctgacagcttggaagagagtagtggttctcccagcacacagctggagatctgagaacggatagactgcctctcacgtgggtccctgacccctgagtagcctaactgggaggcacccctaagtaggggcagactgacaccacacatggccgggtatccctcagagatgaaacttccagaggaacgatcaggcagcaacatttgctgttcaccaatatccactgttctgcagactccgctggtgatacccaggaaaccagtctggagtggacctccagcaacttccaacagacctgcagctgagggtcctgactgttagaaggaaaactaacaaacagaaaggacatccacaccaaaaccccatctacatggcaccatcatcaaataccaaaggtagataaaaccacaaagatggggaaaaaacagagcagaaaaactgaaaattctaaaaatcagagcgcctctcctcctccagaggaacgcagcccctcaccagcaacagaacaaagctggacggagaatgactttgacgagttgagagaagaaggcttcagacgatcaaacttcttcgagctaaaggaggaagtacgaacccaatgcaaagaacttaaaaaccttgaaaaaagattagacgaagggctaactagaataaccaatgcagagaagtccttaaaggacctgatggagctgaaaaccatggcacgagaactacgtgacgaatgcacaagcttcattagccgattcgatcaactggaagaaagggtatcagtgatggaagatcaaatgaatgaaatgaagcgagaagagaagtttagagaaaaaagaataaaaagaaacgaacaacgcctccaagaaatatgggactatgtgaaaagaccaaatctatgtctgattggtgtacctgaaagtgacggggcgaatggaaccaagttggaaaacactctgcaggatattatccaggagaacttcccccatctagcaaggcaggccaacattcaaattcaggaaatacagagaatgccacaaagatactcctcgagaagagcaactccaagacacataattgtcagattcaccaaagttgaaatgaaggaaatgttaagggcagccagagagaaaggtggggttacccacaaagggaagcccatcagactaacggcggatctctcggcagaaactctacaagccagaagagactgggggccaatattcaacattcctaaagaaaagaattttcaacccagaatttcatatgcagcgaaactaagcttcataagtgaaggagaaataaaatcctttacagacaagcaaatgctgagagattttgtcaccaccaggtctgccctaaaagagctcctgaaggaagcactaaacatggaaaggaaaaaccactacaagccactgcaaaaacatgccaaattctaaagaccatcgaggctaggaagaaagtgcatcaactaacgagcaaaataatcagctaacatcataattacaggatcaaattcacacataacaatattaactttaaatgtaaatgggctaaatgctccaattaaaagacacagacaaactggcaaattggataaagagacaagacccatcagtgtgctgtattcaggaagcccatctcagtgcagagactcacataggctcaaaataaagggatggaggaagatctaccaagcaaatggaaaacaaaaaaaaaggcagcagttgcaatcctagtctctgataaaacagactttaaaccaacaaagatcaaaagagacaaagaaggtcattacataatggtaaagggacaaattcaacaagaagagctaactatcccaaatatacatgcaccaaatacaggagcacacagattcataaaacaagaccttagagatgtaaaatgagacttagactcctatacaataataatgagagactttaacaccccactgtcaacattagacagatcaacgagacagaaagttaacaaggatatccaggaattgaactcagctctgcaccaagcggacctaatagacatctacagaactctccaccccaaatcaacagaatatacattcttctcagcaccacacctcacttactccaaaattgaccacatagttggaagtaaagtactcctcagcaaatgtaaaggaacagaaattataacaaactctctctcagaccacagtgcaatcaaactagaactcaggattaagaaactcactcaaaaccacacgactacgtggaaactgaacaacctgctcctgaattactgggtacataatgaaatgaaggcagaaataaagatgttctttgaaaccaacgagaacaaagacacaacataccagaatctttgggacacatttaaagcagtgtgtagagggaaatttataccactaaatgcccacaagggacagcaggaaagatctaaaattgacaccctgacaacacaattaaaagaactagagaagcaaaagcgaacacattcaaaagctagcagaaggcaagaaataactaagatcagagcagaactgaaggaggtagagacacaaaaaacccttcaaaaaatcaacgaatccaggagctggttttttgaaaagatcaacaaaattgatagaccactggcaagactaataaagaagaaaagagagaagaatcaaatagatgcaataaaaaatgataaaggggatatcaccaccaattccacagaaatgcaaattaccaacagagaatactataaacacctctacgcaaataaactaggaaatctagaagaaatggataaattccttgacacatacactctcccaagactaaaccaggaagaagttgaatctctgaatagaccaataacaggctctgaaattgaggcaataattaatagattaacaaccaaaaaaagcccaggaccacatggattcacagccgaattctaccagaggtacaatgaggagctggtaccattccttctgaaactattccaatcaatagaaaaagagagaatcctccctaactcattttatgaggcagcatcatcctgataccaaagcgtggcagagacacaacaagaaaagagaattctagaccaatatccctgatgaacattgatgcaaaaatcctcaataaaatactggcaaaccgaatccagcagcacatcaaaaagcttatccaccatgatcaagtcggcttcatccctgggatgcaaggctggttcaacatatgcaaatcaataaatgtaatccagcatataaacagaaccaatgacaaaaaccacatgattatctcaatagatgcagaaaaggcctttgacaaaattcaacagcccttcatgctaaaaactctcaataaattgggtattgatgggatgtatctcaaaataataagagctatttatgacaaactcacagccaatatcatactgaatgggcaaaaactggaagcattccctttgaaagctggcacaagacacggatgcactttctcaccactcctattcaacatagtgttggaagttctggccagggcaataaggcaggagaaagaaataaagggtattgaaataggaaaagaggaagtcaaattgtccctgtttgcagatgacatgattgtatatctagaaaaccccatcgtctcagcccaaaatctcaagctgataagcaacttcagcaaagtctcagaatacaaaatcaatgtgcaaaaatcacaagcattcttatacaccaataacagacaaacagagagccaaatggtgagtgaactcccactcacaattgcttcaatgagaataaaatacctaggaatccaacttacaagggatgtgaaggacctcttcaaggagaactacaaaccactgctcaatgaaataaaagaggatacaaacaaatcgaagaacattccatgctcatgggtaggaagaatcaatattgtgaaaatgcccatactgcccaaggtaatttatagattcaatgccacccccatcaagctaccaatgactttcttcacagaattggaaaaaactaaagttcatatggaaccaaaaaagagcctgtattgccaagacaatcctacacaaagaaaaacaaagttggaagcatcatgctacctggcttcaaactatactataaggctacagtaaccaaaacagcatggtagtggtaccaaaacagatatattgagcaatagatcgggaacagaggtctcagaaataacaccacacatctgcaaccatctggtctttgacaaacctgacaaaaacaaaaaatggggaaaggattacctgtttaataaatggtgatcagaaaactggctagccatgtgtagaaagccgaaactggatccctgctttacaccttatacaaaaattaactcaagatggattaaagacttgaatggttttagacctaaaaccataaaaaccctagaagaaaacctaggcaataccattcaggacagaggcatgggcaaggacttcatgactaaaacaccaaaagcaatggcaacaaaagccaaaagagacaaatggggtctaattaaagtaaagatcctctgcaaggcaaaagaaactaccatcagagtgaacaggcaacatacagaatgggagaaaattcttgcaatctacccatctgagaaagggctaatatccagaatctacagagaactcaaacaaattacaagaaaaaaacaaacaactccatcaaaaagtgggcaaaggatatgaacagacacttctcaaaagaagacatttatgcagccaaaagacacatgaaaaaatgctcatcatcactgctcatcagagatatgcaaatcaaaaccataatgagataccatctcacgccagttagaatggagatcattaaaaagtcaggaaacaacacatgctggagaaaatgtggagaaataggaatgctttaacactgttggtgggagtgtaaactagttcaaccattgtggaagacagtgtggtgattcctcagggatccagaaccagaaataccatttgacccagtgatcccattactgggtatatacccaaaggattataaatcatgctactataaagacacatgcacacatatgtttactggggcactattcacaatagcaaagacttggaaccaacccaaatgtccatcaatgacagactggattaagcaaatgtggcacatatacaccatggaatgctatgcagccataaaaaaggataagttcgtgtcctttgcagagacatggatgaagctggaaaccataattctcagcaaactatcacaaagacagaaaactaaacaccgcatgttctcactcttaggtgggaactgaacaatgacaacaattggccacagggcagggaacatcacacacgggggcctttcgggggtggggccctgggggagggatagcattaggagaaatacctaatgtaaatgatgagttgatgggtgcagcaaaccaacatggcacatgtatacctatgtaacaaacctgcacgttttgcgcaggtaccctagatcttaaagaattaaaaaaaaaaaaggaaaagaaaaagaaaaagataacagtgaaaagataccgaaagaagggggaataatactagtgaaggacgtcatttgtttctaaagctagggagaaaagatcacagcagacagctaaagtacacaatactccaagtgagtattcaagagtttataaaaaaaaaagtaggttcaataacacagatgtaaaattgctctcccaaggcttttcactatttgatgagtcaacagtcatcacatgaaaatctatttttaatttacaaatcaaaaagtggttgacctttaaattataaattgtacttccttctctggcttcaccactgttttataataaaagcaagagaaggaaaaccatattagaaaacagaatgaaggtagagttcatataatttacatatatagaagttctttttacttcagcacatttaatttattaactttcatccacactggcatggtaagattccataaaaatagcagtccaactctaccactaaatagattattagtggttatgagctgtgatcttacgtcttgtatgtcattctgtttatttctatggcctgattcttgtattcatgtataaagttgaagattttttcttaatcaacattataaataggatataacatcataaaccctgtcaagtcaaataggtgtaaaataatgggtcttcaaaaatgctggtgaaaagagagaagtaattaagtaattatgatggacaggaaggtggaagttttttttaagtattgaggaaatattaaacggattttgcaatgtatttaattaaaaagtaagaatggttttgaaagatgacaacatgtgaatcagccaaatgtgaaaagtgctatgtaattgtaaatcacaagaaatggaaaagtgatttgtataacgggaacactcttgctggctaagggttcatgacctctgcatactcgttaactgaggataagggtgtgttagagaatataagagttaagaaggtgtcttagtctgttctcacactgccaataaagacatacccgagtctgggtaatttataaaggaaaggggtttaattcacagttccacatggctagggaggctccacaatcatggtggaaggcgaaagaggagtaaggtcacatcttttacactgcagcatgcaagagagcgtgtgcaggggaactcccatttataaaaccatcagatctcgtgagacttactggctatcatgagaacagcatgggagagacccacccccatgattcaactatcccccactgggtcacccctcccatcacatgtgggaattatggtagctacgattcaagatgagatttgggtggggacatagccaaaccatatcagaagggttatggtgcagatcaagtgtttatctgaatccatggtgaattccatagatttaaggtgcatctagatttctacaacatcaaaatgaggaccaaagtaccaatggtgtaccataactgctaagatttttcaccatgacttacttgtggaaatcataaaggatgctgtttgttaccttttataatatattttctgtggacctcagctggtctgtttggaaaagaatttatacacatgcatatacatatatgacatatatgttctatacatgtatatatataagaggaaatagttatggctagtcttgaggttttggagaatgagttcatatttctatttgttgaaaacatattcaaggactaaaaacgtaagcctctttcagtcatttggactctcaaattaattaatttatgaagagccatttagagctcatcctgttttaggccgggcacgatggttcacacctgtaatcccagcactttgggaggcagaggcggacggatcacctgaggtcaggagattgagaccattctggctaacacagtgaaaccctgtctttactaaaaatacaaaaaattagccgggtgtggtggcaggtgcctgtagtcccagctactcgggaggctgaggcaggagaatggcgtgaacctgggaggcgaaccttgcagtgagtcgagatcgtgccactgcactccagtctgggcgacagagcgagactccttctcaaaacaagaacacaaaaacaaaccaaaacaagcaaacaaaaaacaacaaaagaactcatcttgtttcaaaagaaaaatttctgtttattgtttcccaaatgtctatgtcttgtttctccaattatatcgctaaagttcttcactggcaatgactctttttctaattataacatctagtctaaataaacacctattgaatgaaagaagagttcaaactaaaaaattaggtcattataaattagcatgaactatgaacccctatatcaacatttctgtataggactcatgttattccttaaataaatccttaaattctctattcatgttttccttaaaaacagactacaggccaggcactgtggctcacgcctgtaatcccaggactttgggaggctgaggcgggtggatcacgaggtcaagagacggaaaacaccttggccaaaatggtgaaaccccttctctactaaaaatacaaaaattagctgggcgtggtggtgcgcgcctgtagtcccacctactggggaggctgaggcaagagaattgcttgaatccgggaggcagaggttgcagtgagccgagatcgtgccattgcactgcagcctgggcgacagagccagattccgtctcaaaagaagagactacagagataagccattggtgggagtctatatgcaagcaaaactaaatcataattaattgggagaagtttttgatgattccacttttattttttaacaattcagtttccatttccttcatttctaatatattttgaaaagtgtatgttttgctgttattcttttttttttttttttttttttgagacggagtctcactctgtcgcccaagctggagtgcagtggcatgctttcggctcactgcaagctctgcctcctgggttcatgccattctcctgcctcagcctcctgagtagctgggactacagatgcctgccaccacgcccggctaaatttttatattttaatagagatggggtttcaccgtgttagccaggatggtctcaaactcctggcctcatgatccacctgcctcggcctcccaaagtgttgggattacaggcgtgagccactgcgcctggccgttttgctgttattcttaaagacataatgaaaaacagcaacacatttctcaaacggttgttaaaaattagaactttattgacttacattagtctgagaatgtacacaaagaatatcatagttcatgtaacaagagcctccatttcagagagaaaacacgaatagggatacatataagcacatgccatttaaatctatcagattgttgagtgataataaaataccatttcagaactatgtttcaaactcataggaaacaataaacaataacctttagaacagaatctttaaagtttagcttttaagcaagtactattataacagaaaagctttttggggggctgcatttcaaaactcattcatgcatcctaggtaacaatttggggtcactaatgttaatattaacatatgtatcagatgcatgtctagaaaacacacacacacacacattcattcattctcattctctctccccctccctcctcaccctcccatctttctctctctccccatccccatatacagacatatagtcatatggagaaagagtacatggaaaatagcagacactaaaaacaagctgtgtaatcttataaaagacataaaaaccattgaaacacttacttcatcagccaccatacacctggaaaaaaaaaaaaaaaaaaattaattatcagagtgaacctttttccttttttttttgagatggagtctcgctctgtcaccaggctggagtgcagtggtgcgatctcagctcactgcaacctctgtctcccaggtccaagtgattctcctgcctcagcctcctgagtagctggaactacagatgcgtgtcaccacgcccatctaatttttgtatttttagtagagaaggggtttcactatgttgcttaggatggtatcgatctcttgacctcgtgatctgctcgcctcagcctcccaaagtgctgagattacaggcgtgagcaactgtgcccggccaaagtgaaccatttttaaagttctgattaagtagcttgccagaaaatagttcataaatactaaagtagtaagccagagagaggtgtttataagtatgagaacatgggccagtgctgattttatatgactctccagctgccaaaggcatatggctacgtgggagtgttagagcttcagatgtgctgttcccacagcccacccatgaagatagttacaatgacccttcaaaaacgtgagcaaagtggtaagtgattgtaccaatgaccaccctcctcatccttaaaccttaagattggtcttccctataaagagaagaatgctgcattaaaatataagaaaataagtgtgaattacatattagcataagttaaatacataactatatatgctaagcctacctttaagatgagtttttatttctttctttttttttttttttgagacggagtctcgctctgttgcccaggctggagtgcagtggtgcgatctccgctcactgcaagctctgcctcccaggttcatgctattctcctgcctcagcctcccgagtagctgggactacaagcacctgtcaccacgccaggctaattttttgtatttttagtagagacggggtttcaccgtgttagctaggatggtctcgatctcctgacctcgtgatccacccacctcggcctcccaaagtgctgggattacaggtgtgagccaccgcgcctggccgctgagtttttatttctattactttgctaaactttcttttctcagttctttcttattaacctgtataaataaattctatgcaatgataattgaggatgggggcataaactcaagtattaagtagcagaaaaacaaggggcaaagggaaagaatagcaggcatggtcaggatcatcgggtgttcctttgagacagcaaacatatgataaggggtaaaactaatcccttaagtgaggatatttccagacaacctaaaaaaatagctggaatattataaaaattggcaagaggccaggtacagtggctcatgcctgttatcccagtggctcaggagggtgaggtaggaggatagattgaggccaggaattggaagccacactgagctatgattgtcccactgtactccagcctggacaacaaagggagaccctatctctaaaacaaaacaaaacaaaatgaaaatacaaaaaaaaaaaaagggggggggggcaggaaaaaaactttttctattttattgttcctttattcccagttgtcttgatatcatataatcttataagatttatttctatatataaaatacaaatcatggccgggcacggtggctaacgcctgtaatcccagcactttgggaagccgaggtgactggatcacctgaggtcaggagtacgagaccagcctggccaacatggtgaaaccctgtctgtactaaaagtaaaaaattagccaggtgtgatgacgcacccctgtagtcccaggtacttgggaggctgagcaggagaaacacttgaacccgggaggcagaggttgcagtgagccaagatcatgccactgcactccagcttgggcaacagagtgagactccgtctcaaaaaccacaacaacaacaacaacaacaaattaagcatttggagtaaataaattaccaatgaatgcattacagttaaatgaaaatgaaatttcattgttcaaaaagatgtcagcttacccaataaatatgttttttggtttttttttttctgagacagtctccctttgtcactcaggctagagggcagtggcacaatcacggctcactgcagccttgacctctaatgatcctaccacctcagcctccaaagtagctgggactacaggtgtatgccaccacacccagctattttttttatttgtagagacagggtttcactatgttgttcaggttggtctagaactcctggactcatgtgatccacccacctaggcctcccaaactggtgggattataagcgtgagccactgcacctggccccaataaatatctttacaaaaaataaaattcaaatactttaattgaaaattaaaacatatataagagtaaaaaatttattacattctttgtaaacaagccaacagattagaaaactaaaaagcaatacttggaaaaacatgattttttttccaggaagattcatgtatagatttcaaagcaaaacgagaacatgaactttttttttttaagatgatcattattgacagctaaataaatagactggaagatgcagtacgtggattatcttaaagcacagaacagaaagcaaaataaatggaaatactgaaggaatagaaagacttgaaaatagtcccagaagacctattttacaaaaaataggtgttcaaaaagagaaaaagcaccagatggaggagaggcaacaattaagtaaataataaagggaaatttctctgggctggcttttggtggataagtgaaaagggaaaccaagtttcaggatggattaaagacaaaagacaaatatctattatacccttgtaaaattcattaattttacaaataaagaaaaaatcttctaagtgtccagaaagaaagaacaattatccataaagagaaaactaggactggtactggtctaatcatcaactctagaagctagaataaaatgcaacaggatctaaactaactgaaacgaaaagcagcagaagttattaaccttttttttttagatggagtctcactctgttttcctggctggagtgcaacggcacgatctcggctcactgcaacctctgctttccaggctcaagcgattctcctgcctcagcctctcgagtagctgggtaaacaggcgcccgccaccatgcccagctaatttttttttttttaagtagagacagggtttcactatggtggccaggctggtctcaaactcctgatctcatgatctgcctgccttggcctcccacagtgctgggattacaggcatgagccaccatgcccagcttagaagttatgaatcttatactcagccgagatacccccgatttgttacgggatggcaaaaagatatttaaggctattcaagattaccaaaattacaccactaaagcaaaccatttcagtaaaaatacctgagaaaataaccaaacaataaaaacaccttaacatagattcaagataggaaaaaaggaaaagggaatctggtaagcaatgaagcttgatatgtgataatttaatggaccatatacactctaaataaagactagaaacagaagggacataatccaaaaatctgaatatgcaaaactgaagggaggtaaggagatgggaagctgaaattaaactaaagcaaaacagatgatattttagtcaagagactagatgtgatcacctaggaaggaagagtatagagacaagggaggaggaaaagaggagatgttaactgggtatagagtttcagatttactagatgaaaaagttgttacctataccttacataataagatatagttaacactactacactgtaaaattaaaatggttaaggtagtaaattttacattgtgtttttttaccacaagggaaaaaaagccttggagcactacaacaatgagaagtcaagagaggggaagaatccagcaaaagagaatgagaaggaatgtctagttatgtaaaagatactaagctgggtgtagtggcttatgtccataatcccgaagtgctttgggaggctgaggcaggattgcttgaacgcaggactttgagatcagcctggacaacatagcaagaccttgtctctacaaaaaaaaaaaaaaaaaaaaaagtacactcttcacagaaacagaaaaaacaattctaaaacttatatgggaccacaaaagacccagaatagtcaaagccatcctgagcaaaaacaaaaccggaggaatcacattatctgacttcaagttatactacagagctattgttaccagcaaggtactagcataaatacagacacacagaccaaaggaacagaatagagaaccgagaaacaaatccatacatctacagtgaactcattttggacaaagctgtcagaaacatacactgggagaaagggcagtctcttcaataaatggtgctgggaaaactggatatctgcattcagaagaattaaaccatctctcaccgtaaacaaaaatcaaatcaaaatggattaaagacttaaatctaagacctcaaatcatgaaactactacaaggaaacactgaggcgatactccaggacacaagaatgggcaaagatttctttttttttttttttttaattttttttagttttgagacacagtttcattctgtcacccaggctggagtgcagtggtgcaatcttggctcactacaacctctgcctcccacgttcaagcgattctcatgcctcagcctcctgagtagctaggacaacaggcgcacaccacgacgcccggctaatttttgtatttctagttgagacggggtttcaccattttggccaggctggtctcaaacacctgacctcaaatgatccacctgcctcggcctcccaaagtgctgggattacaggggtgaaccacggtgcctggctgggcaaagatttcttgagtaataacccacaaacacaggcaaccaaataaaatggacaaatgggatcacatcaagttaaaaagcttctgcacagaaaaggaaacaatccacaaagtaaagagacaacccacagaatgggagaaaatatttgcaaactatccatctgacaagggattaataaccagaataaagaagaagctcaaacaactcttcaggaaaaaaatctaataatccaattttttaaatggacaaaagatctgaatagatatttttcaaaggaagacatacaaagggcaaacagttatatgaaaatgtgctcgacagcattgatcatcagagaaatgcaaatcaaaactataatgagatatcatctcaccccagttaaaatgaaagacaggcaacaacaaatgctgacaaggatatggagaaaagggaacacttgtacactgctggtgggaatgtaaattagtatagccactatggggaacaatttggaggttcctcacaaaaactaaaaatagagcttccatctgatccagcaatcctactgctaggtatatacccaaaggaaaggaaattagtatatcaaagagatatctacactcccatgtttattgcagcactattcacaatagccaagatttggaaacaacctacatgtccatcaacagatgaagagataaagaaaatgtggtacatatacacaatggagtactattcagccataaaaaagaatgagatcctgtcatttgcaacaacatgggtggaactagaggtcattatgttaagtgaaataagccaggcacagaaagacaaactttgcacgttctcacttatgtgtgggaatccaaaattaagacaactgaactcatggagatagagaatagaatgatggttattagagactgggaagggtagtggtggggtagggggaaagtcgggatggttaatgggtaaataaaaatagaatgaataatatctagtattcaatagcacaacggggtgactatagtcaataataattaaattgtacatttaaaaataattaaaacaatataattggattgtttgtaacataatgaataaatgcttgaggtgatacatctgcttattatgcattgtatgcctgtatcaaaatagctcatgtaccccataaatatatacacttactctgtacccacaaaaacaaaaaagaaaaaatttaaaataaaatttaaaaatattagccaggtgtgttatccacgcctgtagtctcagctactagggatgctgaggcaggaggatcccttgagcccaggagattgagtctgtagtgagctattattatcatgctactgtgctccagcctgggcaacagagtgagactgcatctaaacaaacaaacaaaaacaaacaaaaccaagagaccggacaaggtggctcatgattataaccccagcactttggtaagctgaggtgggaggatcactttagcgtaccaatctgagaccaacgtgggcaacatagcgagacctcctctccactaaaactaaaaataaaaaactaggcaggtgtggtggtgtgtgcctctagccccagctacttgggagactgaggtaggagaactacttgagcccaggaagtttaatctgcagtgaggcatgatcgtaccactgcacttcagcctgggcaagaaagccagaccctgactcaaaaaaaaaaaaaagaaaagaaaagaaaagaaaaaccttttattttcactttaggatgggtatatcctgttgaagaaataaggaagatttctattatagttaaagatggcatttgaacatgctcatgtagctcctcttcttcttaaaactttttaaccagaaatattgcttaatttcttcagccaagaacccatttctaatttaagttattttagcaggagggctactaaaagtaaccattgtttccattggtaactgtgaatacatgctagggatacagtgggcttccatgcctgctttctgctacactctggaaatgtcctgcttgctgtgctttcaataagctacagtattctgctgcttttacagccctagatcaagaggaaagctgaaagttaccatgtaaccctttcccttacctctcctcccccaaaacatatacaaggaggagacacatacttagggtcattgtctgcatatgtagcagaagtggctgtttctccatatcttgcacatttatgaactacatatctttggagaattgcagcaataaggatcatgtccatttgctctccacgttttacatacctgttctttttctttttgtttttcttattatttatttatttattttttgagatggagtctcgctctgtcacccaggctggagtgcagtggcgccatctccgctcactgcaagctctgcctcccgggttcacgccattctcctgcctcagcctcccaagtagctgggactataggtgcccgccaccacacccggctaattgttttgtttttttagtagagacggggtttcaccgtgttagccaggatggtcttgatctcctgacctcgtgatctgcctgcctcggcctcccaaagtgctgggattacaggtgtgagtcactgcacctggccctacatgcctgttcttaatttcatctactagcttctgactcctgacttccactgttaaaggtatcaagtcttgagctgcacatttcattgtatctttttgcccttactctttttttctacctcctttgaacaaacaaaaaccatttcttttgtcactttttttttttttttgagatggagtcttgctctgtcgcccaggctggagtgcagtggcgctatctcggctcactgcaagctccgcctcctgggtttacgccattctcctgcctcagcctccggagtagctggcactataggcgcccgccaccatgcccagctaatttttttttttgtatttttagtagagacggggtttcactgtgttagccaggatggtctcgatctcctgacctcgtgatccgccagccccggcctcccaaagtgctgggattacaggcgtgagccactgcacccagcattttgtcactttttttattgatcagttctccttggatttctgtgtaaactgggttttcatatacctatccaaccaattaaagtattttccctaagtgatgacaaccacctaatcacactgtgttcagtacacttgttgaatctttggcttgtcatagttgctttggttggctgtttcacatccatagtgtgactgtgatgatagtgtgatttgcaaatgaactacgcctaggttagatgatgattctggagaagatatgggttttaaaagatatttcattgatttacttgaacggccatacatgtacatggaccaacagtaaaaaggcacaatagaatatacagtgaaatgtttctcttccccctgtcacctggtctcccagctccccaggccccttccgagaagcaacctctggacctgctttcttatgtatccttctagaagtctatgaatttataagcatatgtgaattatagatcagaaatacagtgttttaaaactacaacctcagatagtattaaagtgtacattcaatgggtggcaacatattaagtatgccatcgacaaaaattcacaggtttttaaaatatgaacaatgttataggaaataagatcacaggctaaagttttagagtaagactgactaagctgcaccctggaaggaatgagggtgaacacatataaactggagggttttttttacattgtcttttcataggcatgccacttatattcttaagagaagggcatacaaggttagacagaagattttctttagacactttaactcacaacatgatgacaaaaatgaaaaatgtttagtattgttactaaaaatatttagtattgcttagtattctatgtttttcacttataactgagttgttgtttgagtgctgtttgtaaggaatgccaataacatgcttttgaatgagaaagatcttggtacatggtcacggggaaggggcaaaacacaagattctatcaattcgagactaccatttctgtaactggtgatctctgtgtcattgtagctctttcagtgtataaggcctaatttgtttttcgaaaaggttttcgtatttttctcaattctgaacttaggactttgaatttattcctattaaattacatcctggctgggtatggtggctcacacctgtaatcccagcaatttggaaggccaaggcaggcggattaagaggtcaagagtttgagaccagcctggccaacatggtgaaaacccatctctactgagagtacaaaaattagccgagcgtggaagcgggctcctataatcccagctactcgggaggctgaggcagaagaattgcttgaatctgggaggaagaagttgccgtgagccaagattgcaccactgcactccagcctgggcaacagagcaagacttcatctcaaaaatagtaataataaaaataaataaataaataaataaataacaccctattggcatggactctgtgtgttcactcttctgataaatccatattttgtttctttgtctagtctttttttttctctaaatggagacgtgctctgttgcccaggctggagtacaatggcatgatctcggttcactgcaacctccgcctcctgggttcaagtggttctcctgcctcagcctcccaagtagctggaaatacaggcaagatggggtttcaccatgttggccaggctggtctcgaactcctgacctcatgatctgtccaccttggcttcatctagtcttaatagaaaggtcttatgtatcaaactaaagtcataacttttggcactgtaccagaaactttctttaggtcactaattcttaaaaggttgttcaccaatatattctaaggcaggggttggcacatttttttctaatggtaaatattttaggctttacaggtcatgcatgccaattgtctgtcacaactactcaactctgttctaacaccggaaaagcagccaatgacaacaaataaatgaatgagcagggttgtgttccaaaaaaactttatttatcaacataattggtgggcctggtttggcctacggacagtaatttacaaacttgtaaggaactcagaattctctttgttaactgttaagtcatttagattaaattccaaaaaatattaccataagtatattctgggtcatctgaacaactactttaaaatcaggcctatgtatatttagtggtcccttttgcatttaggattatatgagaaatcccttcccatttacctatattaaacacttcttattgcagaatgatgagtaaatacgtttttacaatagtcggacttagggtagtgtggaattgagacatcaccagacacataggggtgcatgcacggagaacatcatactcacgagggaactgatttcttttagcttttaaaatttaaactttaattatcagtaattatgagagcaaatatgaaggatttttctttcccggattgcagacatagttagatacctacttgagagagatttcaataacaccccaaagttgatgtgatctttatgtgatgaagatggctatagtgcttccaaatcatccctcgataaaaacggccttagaagttgtggtagagcttgctgttgcttttccaaaatcccttctccccttccccctcacaaacacaccctgtcggtggggggcctgtggtgaactaaacctctccttttccaatctctttttcaactagctgtggttatatgacaaaatgtggccaatgaggccttagtcaacataactaggtggtgattctgagaaagcttgttaaaatagggttgactcagttagcacatgtcgttttgtcttcttcctttcttcctgcatcacgcaatgatgccaaatctggaaccgtaatagctgctttgtgatctactaggcagaaaaggacaagaagattggaaaggtgtggctctaaactcctgttaactgcaggagaaaatagtccaatatattttagctattattatgtgcagctgaactcaattcctcatcattaaaaaaggaagtataggatatgaataaactttcaatatttaagagacatgaggctattagttttggccataaaacctcaatagcatcaatttagcatctgccaaataatactatcatattaaattaatactgttaactgaactatttttattttgccttatttgtatttaattttgaaaatttttcatattttgaaaatatttcctaaaagctataagtatatgaaattttttaacctagttttggtgtgtacatatttaacataatacaaaaattttaagtaaacaatgaggcttttggaaaatatttttcctttgaaatgacttcagtgattaatcacatacgaggactgctctagagttattcattcatcttgatttgaggcaataatttaatatttcaatgtaaactttattgcatatacacgtgttagttcattctttctctctttttttttttttttttgagacggagtctcgctctgttgcccgggctgcagtgcagtggcacgatcttggctcactgcaacctccggctcccaggttcaagtgattctcctgcctcagtctcccgagtagctgggactacaggagcccaccaccacgtccggctaattttttgtatttttagtagagatggggattcaccgtgttagccagaatggtcttgatctcctgacctcatgatccacccaactcggcctcccaatgtgctgggattacagggcttagccactgcacccagacttttttttttttaagacagtttcgctcttgtcacccaggctggagtgcaatggtgcgatcttagctcactgcaacctccacctcctgggttcaagcgattctcctgctcagcctcctgagtagctggaattacaggtgcgggccaccacgtccagctaatttttgtattttttgtagagacgaggttgcaccatgttggccagactggtctggaactcctgacctcaggtgatctacccacctcagcctaccaaagtgcgaggattacaggcatgaaccaccgcacctggccagtccattctttttcaatgtaaccttattgcataatacacatgtattaggccattcttccactgctataaacaaatgcctgagggggtgcagccaagatggccaaataggaaccgctccaatctacagctcccagtgtgggcgacgcagaagacgggtgatttctgcatttccaactgaggtacaaggctcatctcactggggagtgtcggaaagtgggtgcaggacagtaggtgcagtgcacccagcaggagccgaagctgggtgaggcattgcctcacacgggaaccgcaaggagtcagggaattcccttttctagtcaaacaaaggggtgacagatggcacctggaacatcaggtccctcccaccctaatactgtgcttttctaacggtcttagcaaatggcacaccaggagattatatcccgcacctggctcggagggtcctccgcccacagagcctcgctcattgctagcacagcagtctgagatccaactggaaggcggcagcaaggctgggggagaggcgcccgccattgcggaggcttgagtaggtaaacaaaccagcctggaagctccaactgtgtggagcccactgcagctcaaggaggcctgcctgcctttgtagactccacctccggggcagggcattgccaaacaaaaggcagcagaatcctctgcagacttaaatgttcttgtctgacagctttgaagagagcagtggttatcccagcacgcagctggagatctgagaacagatagactgcctcctcaagtgggtccctgaccaccgagtagcctaactgggaggcacccccgagtaggggcagactgacacctcacacggccgggtactcctctgagacaaaacttccagaggaaggatctggcagcaacatttgctgttcaccaatatccgctgttctgcagcctccgctgctgatgcccaggcaaacagggcctggagtggacctccagcaaactccaacagacctgcagctgagggtcctgactgttagaaggaaaactaacaaacagaaaggacatccacagcaaaatcccatcggtacgtcaccatcatcaaagaccaaaggtagataaaaccacaaagatggggaaaaaacagagcagaaaaactggaaactctaacaatcagagcgcctctcctcctccaaaggaacacagctcctcaccagcaacggaacaaagctggatgcagaacgactttgacgaggtgagagaagaaggcttcagatgatcaaactactctgaggtaaaggaggaagttcaaacccatggcaaataagtcaaaaaccttgaaaaaaattagacgcatggctaactagaataaccaatgcagagaagtccttaaaggacctgatggtgctgaaaaccaaggcacgagaactatgtgacaaatgtacaagtctcagtagccaattctatcaactggaagaaagggtatcagtgatggaagatcaaatgaatgaaatgaagcgagaagagaagtttagagaaaaaagaataaaaagaaacgaacaaagcctccaagaaatatgggactatgtgaaaagaccaaatctacatctgattggtgtacctcaaagtgacagggagaatggaaccaagttggaaaacactctgcaggatattatccaggagaacttccccaaactagcaagtcaggccaacattcaaattcaggaaatacagagaatgctacaaagatactcctcgagaagagcaactccaagacacacaattctcagattcaccaaagttgaaatgaaggaaaaaatgttaagagcagccagagacaaaggtgggggttacccacaaagggaagcccattagactaacggcggatctctcggcagaaactctacaagccagaagagagtgggggccaatattcaacattcttaaagaaaagaattttcaacccagaatttcatatccagccaaactacgctgcaaaatcatgccaaaatgtaaagaccatcgaggctaggaagaaactgcatcaactaatgagcaaaataaccagctaacattataatgacaggatcaaattcacacataacaatattaaccttacatgtaaatggactaaatgctccaattaaaagacacagactggcaaattggataaagagtcaagacccatcagtgtgctgtattcaggaaacccatcttacgtgcagagacacacataggctcaaaataaagggatggaggaagatctaccaagcaaatggaaaacaaaaaaaggcaggggttgcaatcctagtctctgataaagcagactttaaaccaacaaagatcaaaagagacaaagaaggccgttacataatggtaaagggataagttcaacaagaagagctaactatcctaaatatacatgcacccaatacaggagcacccagattcataaagcaagtcatgagtgacatacaaagagacttagactcacacacaataaaaatgggagactttaacatgccactgtcaacattagacagatcaacaagacagaaagttaacaagcatatccaggaattaaatacagctctgcaccaagcggacctaatagacatctacagaactctccatcccaaatgaacaaaatatacattcttctcagcaccacagcacacgtattccaaaattgaccacatagttggaagtaaagcactcctcaacaaatgtaaaagaacagaaattataacaaactctctctcagaccacactgcaatcaaactagaactcaggattaagaaattcactcaaatccgctcaactacatggaaactgaacaacctgctcctgaatgactactgggtacataacaaaatgaaggcagagatcaagatgttctttgaaaccaacgacaacaaagacacaacacaccagaatctctgggacacattcaaagcagtgtgtagagggaaatttatagtactaaatgcccacaagagaaagcaggaaagatctaaaattgacaccctaacatcacaattaaaagaagtagagaagcaagagcaaacacattccaaatctagcagaaggcaagaaataactaagatcagagtagaactgaaggacatagacacacaaaaaacccttcaaaaaaatcagtgaatacaggagctggttttttgagaagaacaacaaaattgatagaccgctagcaagactaataaagaagaaaagagagaagaatcaaatagacgcaataaaaaatgacgaaggggatatcaccaccgatcccacagaaacacaaactaccataggagaatactacaaacacctctacacaaataaactagaaaatctagaagaaatggataaattccttgacacatacgccctcccaagactaaaccaggaagaagttgaatctctgaatagaccaaaaacaggctctgaaattgaggcaataattaatagtttaccaaccaaaaaaagcccaggaccagatggattcacagccgaattctaccagaggtacaacgaggagctggtaccattccttctgaaactattccatcaatagaaaaagaggggatcctccctaactcattttatgaggtcagcatcattctgataccaaagcctagcagagacaaaacaaaaaaagagaattttagaccaatatccctgatgaacatcgatgcaaaaatcctcaataaaatactggcaaaccgaatccagcagcacatcaaaaagcttatccaccatgatcaagtgggcttcatccctgggatgcaaggttggttcaacatacgaaaatcaatgaatgtaatccagcatataaacagaaccaaagacaaaaaccacatgattatctcaatagatgcagaaaaggcctttgacaaaattcaacaacccttcatgctaaacactctcaataaattaggtattgatgggatgtatctcaaaataataagagctatctatgacaaacccacagccaatatcatactgaatgggcaaaaactggaagcattcccttcaaaacatggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattatatatctagaaaaccccatcgtctcagcccaaaatctccttaagctgataggcaacttcagcaaagtctcagaatacaaaatcaatgtgcaaaaatcacaagcattcttatacaccaataacagacaaacagagagccaaatcatgagtgaactcccattcacaattgcttcaataagaataaaatacctaggaatccaacttacaagggacatgaaggacctcttcaaggagaactacaaaccactgctcaatgaaataaaaaaggatacaaacaaatcgaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactagtaccaaaacagagatatagaccaatggaacagaacagagacctcagaaataatgccgaatatctacagtcatctgatctttgacaaacctgacaaaaacaataaatggggaaaggattccctatttaataaatggtgctgggaaaactggctagccatatgtagaaagctgaaactggatcccttccttacaccttatacaaaaattaattcaagatggattaaagacttaccacgttagacctaaaaccataaaaaccctagaagaaaacctaggcaataccattcaggacataggcatgggcaaggacttcatgtctaaaacaccaaaagcaatggcaacaaaagccaaaattgtcaaatgggatctaattaaactaaagagcttctgcacagcaaaagaaactaccatcagagtgaacaggcaacctacagaatgggagaaaatttttgcaatctacccatctgacaaagggctaatatccagaatctacaatgaactcaaacaaatttacaagaaaaaaacaaacaaccccatcaaaaagtgggcaaaggatatgaacagacacttctcaaaagaagacgtttatgcagccaaaagacacatgaaaaaatgctcatcatcactgctcatcagagaaatgcagatcaaaaccacaatgagataccatctcacaccagttagaatggcgatcattaaaaagtcaggaaacaacaggtgctggagaggatgtggagaaataggaacacttttacactgttggtgggactgtaaactagttcagccattgtggaaatcagcgtggcgattcctaagggatctacaactagaaataacgtttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgcggcacatatacaccatggaatactatgcagccataaaaagtgatgagttcatgtcctttgtagggacatggatgaaactggaaaccatcattctcagcaaactatcgcaaggacaaaaaactgaacactgcatgttctcactcataggtgggaactgaacaatgagaacacatggagacaggaaggggaacatcacacactggggcctgttgtggggtcgggggatgggggagggatagcatttggagatatatctaatgttaaatgacaaattagtgggtgcagcacgccaacatggcacatgtatacatatgtaactaacctgcacgttggcagatgtaccctagaacttagagtataaaaaaaaaagaaaaagaaatgcctgaggctcagtaatttataaagaaaagcagtttagttggctcatggttctgcaggcagtacaataagtatgttgttggcatctgcttctggtgagggccacaggaaacttacaatcatagtgggaggtgaaggaggagcagacacatcatatggcaaatgtaggagcaagagagtgagtggggaggtgtcacacactttcaaacaaccaggtctcacaagaactcactattgtgaggaaagcaccaagctattcatgaatgatccaccctcatgatccaaacatctcccaccaggccttaactccaacattggggattacatttcaacatgaaatttggagaagatatccaaacaatatcactgcataaacagaattaaaaacaaaaaacacatgatcatcttcatagatgctgagaaagcatttgataaaatccaacatcgctttatgataaaaaaaaactctcaacaaattaggcatcagggatatacctcaaaataataagagccatctatgacaaacccacagccaacatcatactgaatggggaaaagctgaaagtgttccaccgaagaactggaacgagactaagatgtctactttcaccactcccattcaacacagaactggaagtcccagccagaggaagagaaagaaatagaaagcatccgaaaaagaggaactcgaattatctttttgcactgatgacatgattttacaccttgaaaaccctaaagatccttccaaaagactcctagacctgataaacaagttcagtaatgtttcaggatacaaaatcagcatacaaaaatcagtagcatttctatacaccaataatgttcaagctgaaaaccaaataaagacttcagtcccatttacaatagccacacacacaaaataaaatacctaggaatacatttaactaaggtagtgaaaggaaagatctctataaggagaactttgtatgaaacactgatgaaagaaatcatagatgacacaaacaaatggaaaaacatctcatgctcatggacacaaagaatcaatatcattaaaatggccacagtgcctaaagcaaagtacagattcaatgctattcctatcaaactaccaatggcattcttcacaggactagagaaaagtattttaaaattcatatgaaacaaaaaagagccccaatagccaaggtaattctaagcaaaaagaacaaagctggaggcatcacactacccaacttcaaactatacaacagggctacagtaaccaaaacagcatgatattggtacaaaaagagacacatagaccaatggaacaggatagagagccctgaaataaggccacacaactacaagcacctaatctttgacaaagctgacaaaaacaagcaatggggaaaggactctatattcaataaatggtactgggataactgtctagccatatgcagaagaatgaaactggaactctacatatcaccatatataaaaattaactcaagatggtttaaatacttaaatgtaagacctcaaactacaaaattcctagaagaaaatctaggaaaatctcttctggacactggactaggcaaagaatttatgattaagacctcaagagtaaatgcaacagaacaaaaaataggtatatgggacttgcacagcaaaagaaacaatcaacagagtaaacagatgacctacagaatgggagaaaatatttgcaaactatgcaactgaaaaaggactaatatctagactctataaggaactggaacgaatcaacaaggagaaaacaaccccattgaaaagtgggcaaagggcatgaacagacacttctcaaaagacatacaagttgccaaaaaacatgaaaaaatgctcaacatcactatcatttgacgaatgcaaactaaaaccacaataagataccatctcacaccagtcagaatggctatcataaagaagtcaaaaaataggccaggtgtggtggctcatgcctgtaatcccagcattttgggaggccaatgtgggcagactgcttgagtctaagagttcaagaccagcctaggtaacatggtgaaaccccaactctattaaaattacaaaaaattatctgggcgtgatggtgcacacctgtagtcacagctacttgggggctgaggtgggaagactgcttgagccccagaggttgagactgtggtaagccctatcatgccactgcacaccaacctgggtgacagagtgagaccctgtctcaaaaaaaagaaaacatatataacagatattggcaagaatatgaagaaaagagaacacttatacactgctgaggggggaggtgagtgtaaattagttcaaccccgatggaaagcagtaaggagttttctcatagaactaaaaatagaattaccactcaaatcagaaaccctactactgggtatttatccatagcaaaagaaattgttttatcaagaagacacctgcactcatatatttatcacagcactatctacaatagcaaagtcatggaatcaacctaagtgtccatcaacagtggactgaataaagaaaatttagtatatatacaccatggaatattaccacaaaaaagaacaaaacgatgtcctttgcaacaacatgcctgcaactggagatcattatcctaatagttactgaaattaaaataactcagaagcagaaaatcaaatacctcatgttctcacttataagtgggagctgatcaatgggtacacataaaaatgaacaatggccactggggactccaaaagggggtagaggcaaaggcgggcaagggttgaaaaactattgagtatgttcactatttgggtgatgggttcaccagaagcccaaaccctcccattacgcaatatacctatgtaccaaacccatacatgtacccctctgaatctataattttttaaaaaagaagtgactgcacccttcttctgcctctgaataaacttataccataacatcagtaacatttggtacacttatttgtttatacggttatctcttacttaaactaagggcttagcactgtgcttgatgctcaaaggtatgttttgtgaatgactaaataaataataatgtgtatttgatggctacaaaaattgaaaaaaatttttgatatatacttgctgtaacctctacatgtccacaatatagagactataacagaaatgctcaggttttttagcatataattcaataaatcaaaacaactagattaaatatgggctagacatgggctgcttcacctacagctgattagtagacaaaatggtgtcacgttatattctgagaggcactcagtttgtaacaaaactatttcacttattcctccatctatcaacattgagttatcaagtatatccacatttttattaatgaagtgattttaatattgtaagtcatttttactacttataaaataattataaactagatcaagtagacctggcttactttttgttgcttttttatataaaatatattttcgtttttaactacaaaatattctaatgaatattattatctaattaagccctaaaaattttctactagttcctgcaggcataatcaagttttttgatctgcagttttatgaataagaataaataattgtgtaaaagctaatgtgtgaaataatggctcagtgggaattattatacatcctgaaaataataaattctctcaaaacagctgaggtataccttttttaaaccatctagtaagatgcagagactatttcctgttttgttcttcattagtgaaagttatagggcaattttctgctaatggaatcagactaatgaagcatattttcaagatattatcaagcattagacactagtttaatttttttaaagcttatgaacagaaaaggcagttcttcttaaaaattcattaggtttttggaatacacaaggatttatttgtattactctggatctattatgtaccttgaaattattacaagctttcatgtctttcctgtatattactgatgtttcataataggtaaaaagaactaaaacaaaacaaaacactgaatgttattttaactagtttttcaaagttataacatatgttgcaaatataggctgcttcacataaagcttttctcctctttcttccctattaagacactttaggacacttcggatatatccttccacgtgcttctgaacattgctgagtaaggatatgatgtctagagctgctaaggatgacaaagtagaaagatgacatgaatagactagtgaatcaaccaatcctagatctatccctctcttacgtgttatgtggtctctttagtgattaagccattttgagttgtatttctgttattgtacaacatcctaattcaaagtatttacaaaaccaggttttaaggccaatcacatttccttcagtttataatggctacatttgaagctaccatcctctgtaacttccttatatctgttgtgagtatttatttactgacaacagcaacaaaggttttaagatacttttccatttacaaagtactatctctcctcatttgatcacagcttggtttaattggcttagtgattttcacaaaaacacatgagactaggaaactgagtacagagatctagggtatttataattatatgctagttaacaagagtctactttaagcttttacagaaatgcaacagactaatttgatacgcaaccaagataaactcagccctctatttccacaggttttgtatctgtggattaaaccaaccaactctacaagccagaagagagtgggggccaatattcaacattcttaaagaaaagaattttcaacccagaatttcatatccagccaaactaggcttcataagtgaaggagaaataaaatactttacagacaagcaaatactgagagattttgtcaccaccaggcctgccctaaaagagctcctgaaggaagcactaaacatggaaaggaacgagtaccaaccgtggcaaaatcatgccaaaatgtaaagaccatcgagactaggaagaaactgcatcaactaatgagcaaaataaccagctaacatcataatggcaggatcaaattcacacataacaatattaaccttacatgtaaatggactaaatgctccatttaaaagacacagactggcaaattggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctcggataaaacagactttaaaccaacaaagatcaagagagacaaagaaggccattacatggtggtaaagggaacagttcaacaagaagagctaactatcctaaatatatatgcacccaatacaggagcatcccgattcataaagcgagtcctgagtgacctacaaagagacttagactcccacataataataatgggagactttaacaccccactgtcaacactagacagctcaatgagacagaaagttaacaaggatacccagggattgaactcagctctgcaccaagtggacctaatagacagctacagaactctccatcccaaatcaacagaatatacatttttttcagcaccacaccacacctattccaaaattgaccacatacttggaagtaaagctctcctcagcaaatgtaaaagaacagaaattataacaaactctctctcagaccacagtgcaatcaaactagaactcaggattaagaatctcactcaaaactgctcaactacatggaaactgaacaacctgctcctgaatgactactgggtatataacaaaatgaaggcagaaataaagatgttctttgaaaccaacgggaacaaagacacaacataccagaatctctgggacacattcaaagcagtgtgtagagggaaatttatagcactaaatgcccacaagagaaagcaggaaagacccaaaattgacaccctaacatcacaattaaaagaactagaaaagcaagagcaaacacattcaaaagctagcagaaggcaagaaataactaaaatcagagcagaacggaaggaaatagagacaaaaaaaaaacccttcaaaaaattaatgaatccaggagctggttttttgaacggatcaacaaaattgatagaccactagcaactctaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattccttgacacacacactttcccaagactaaaccaggaagaagttgaatctctgaacagaccaataacaagacctgaaattgtggcaataatcaatagcttaccaaccaaaaagagtccaggaccagatggattcacagccgaattctaccagaggtacaaggaggaactggtaccatgccttctgaaactattccaatcaataaaaaaagagggaatcctccctaactcattttatgaggtcagcatcatcctgataccaaagctgggcagagacacagccaaaaaagagaattttagaccaatatccttgatgaacattgatgcaagaatcctcaataaaatactggcaaaccgaatccagcagcacatcaaaaagcttacccaccatgatcaagtgggcttcatccctgggatgcaaggttggttcaatatacacaaatcaataaatgtaatccagcatataaacagaaccaaagacaaaaaccacatgattatcttaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctcgctcatcactcctattcaacatagtgttggaagttctggccagggcaatgaggcaggagaaggaaataaagggcattcaattaggaaaagaggaagtcaagttgtccctgtttgcagatgacatgattgtatatctagaaaaccccatcgtctcagcccaaaatctccttaagctgataagcaacttcagcaaagtctcaggatacaaaatcaatgtgcaaaaatcacaagcattcttatacaccatcaacagacaaacacagagccaaatcatgagtgaactcccattcacaattgcttcaaagagaataaaatacttaggaatccaacttacaagggatgtgaaggacctcttcaaggagaactacaaaccactgctcaatgaaataaaagaggatacaaacaaatcgaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtcctggtaccaaaacagagatatagatcaatggaagagaacagagccctcagaaataacgccacatatctacaactatctgatctttgacaaacctcagaaaaacaagcaatggggaaaggattccctatttaataaatggtgctgggaaaactggctagccatatgtaaaaagctgaaactggatcccttccttacaccttatacaaaaattaattcaagatggattaaagacttaccacgttagacctaaaaccataaaaaccctagaagaaaacctaggcaataccattcaggacacaggcatgggcaaggacttcatgactaaaacaccaaaagcaatggcaacaaaagccaaaattgacaaatgggatctaattaaactaaagagcttttgcacagcaaaagaaactaccatcagagtgaacaggcaacctacagaatgggaggaaatttttgcaatctattcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaagtgctggagaggatgtggagaaataggaacacttttacactgttggtgggactgtaaactagttcagccattgtggaaatcagggtggcgattcctcagggatctacaactagaaataccatttgacccagccatcccattactgggcatatacccaaaggactataaatcatgctgctataaagacacatgcacacgtatgtttactgtggcattattcacaataacaaagacttggaaccaacccaaatgtccaacaatgataggctggattaagaaaatgtggcacatatacaccatggaatactatgcagccataaaaagtgatgagttcatgtcctttgtagggactggatgaaattggaaatcatcactctcagtaaactatcgcaaggacaaaaaactgaacactgcatgttctcactcatagatgggaattgaacaatgagaacacatggacacaggaaggagaacatcacactccggggactgttgtggggtgggggaagcggggagggatagcattaggagatatacctaatgctaaatgacgagttaatgtgtgcagcatagcagcatggcacatgtatacatatgtaactaacttgcacattgtccacatgtaccctaaaacttaaagtataataataataaaaacaaacaacaaaaaatatagtaaaaacaatacaaataaaaaatacagtataacaattatttacatagcatttacattgtattaagcattataagtaatctagagataatttaaagtatatgggaagacatatgtaggttatgtgcaaatactatgccattttacatgaaggacatgagcatctgtgggttttcgtatccactggagtactagaaccaatctcctgcatataccaagggatgactatactattgttttgtagtttttattttaaacaaacttctggcccaagaataagaatcacagactcaaatgtttaatgcatttagaggtttttttttaaaatctagggcttaattagctttagtttcaaatatcaacatgcattgtatgtcataatagcctcagaatatacaggaaaaaagtccaaaaggagctattaagtttggatctggagcatatgctaagagccaaatgtacacatttaggacttatatatgggtggtacttaaaactatgagaatggatgatagcctcaggaatttaggtgaaacaagaactgaaaatgacgaaagactcaacactgaagacggtgggcagaggaggaggtactaggaaaagaggcagagatgagagcttaaagaagaatcagaaaagctgaggggcccagaggagcttttctaggaagcagtggttcctcctgagacactacaaagaggctgagatagatgagagttgacaatgaaggttttcctaactatatatacctgtcacttgccaaagtaatgaaaaataaggattctctcttttttttttttttttttttttttttttttgagacggagtctcgttctgtcacccaggctggagtgcagtggtgcgatctcggctcgctgcaatctctgcctcccgggttcacgccattctcctgtctcagcctcccgagtagctgggactacaggcacccaccaccacgtccggctaattttttgtatttttagtagagatggggtttcaccatgttagccaggatgttctcgatctcctgacctcgtgatccacccgcctcaacctcccaaaatgctgggattacaggcctgagccaccgcacctaggctttttttttcttattttcaaccaaagttttccttttcttagttttcatgatgttacaatactattttgtgtacattttggattttacataagattaggaaaggtataaatcaatcgtaggttatatgtgacatacacacgtgtgtgtgtgtgtttatgtgtgtgtgtgtgtgtacagagaaagagagagagaaagataacctaaataacaggaagactctgagagaaaatcatgtttatttggaaataggcactgaaatgggaatatgcatgccatagtaaactgtatgcatctgtagggaggtaacagaaaacaagggtttttaagggtaaaataaggattgcacccatatacaagttctaaacgagaaattgttttgagataactatccttggccacgggaatcagtaacaaggatggcaccagtctaaagatagttgctgggcacatgtcctcacaaaggttttttttttttttccttaaataaaaaaaattatactgctccttgcagagcagggctaccccataggcagtgtacccagaatacccagaagtattattttatataaggttggatggcctttgtgcaaagttgtggtttttgcagtctttggtggtagttgttgttatcaggcatttgtgtctaagaatcctcccttaacagccttccctggctctgtttgttaggttttgtctttgatagggtttttaacacaatagaatttgttttgattttggaaactttaactcgctctctcgccatatacatatatatgtacctttaactctccatatatatgtaccttttgtgtacattttagattttacgtaagatacatatatatatcttagatttatatatatatatatatatatatatatatatataacttatagaggatatttctagaaggctacacaacaaattagtaactttctgcctccagagttgccagtatctggggcactcctgaggaatagggattagagagagactttccacttttgtatctctttaatggtatacatgtggatttatcatcaattcaaaaaattaataaaattaaaactgataaataaaggccattttatcatgttgcacttgttttacagtttaaggaaaaatatttttagacatcaccgtggctgaaaaatatgttgtgacttggtccactgaacccaggatctttgtaacttagtctatggtgaggtagtaggggagtttattaaattaatgttaattaagctagtgttggtcaaatataccatataaaagaataggttgtgattcattcctaactaaggacagactacatatgaatgtccaaatggggctaattgtctttgagctaatatcctacttctgaggctgaagtgtgcatggtaattgataaagtagatctgttttcatgtcctgaatcctgtacttaggattccaaagagagtaagagtgctcttcttatatctgtgcacctcattaaattctcggaataatcaaaatattcttttggagagttttcttgttttctttatatcaatataatttattcaaaagagatataagtactatagaaaaagatgtttttatgtaaagaaattaaaggaaaattttaggctagatacatattgttcagttctatgggtcttcagtaatttagctggtgtttaaaatgattctcaggaaaatataatgctgtttacttttctattttctatctgtatcagaatttggattaaaaatagtaaacaccgagtatgtgcatccaaagatatggctgctggaaacactggagtctatatgtattgatattgtaagtggatgattaatgtaaggagcctcaaggttctggaaaccactctgaaatgaaaagctgctttttgaagtctgcagtcaagctggataaattacaattgaagcaattaacaatgaatttgaaacaaagaatataatttacttcttgtaactatggaaaactgaactgcttgtaaaattctgatagaattgtgtagctgttggcacaccaaaccagatttggcaaatacaatggattgtctttaatgaaggaagttttctttttagctgcaggttaaaaaccctataactcagatcctatttgacattttccaatgaagaaaaaaagcaatttttatttccatggataactgtaattatggagaggcctccttttacaaagtagacttcatttgtagtcaaatatggtatgaaatttctataaagtaaaaagtattattagccatattttcccccttttatagtagcactttaaagcttccattagtcatctttcttaatttctttctcactgttgactccttcctccctcttccagatttccaacatattccacagctcctgccctatttttaaacttttctttgctaccaaaattcctctctgactactctatatctgttgcttccatttttcactatctacaatctccttaaccattttttaatgatgtttacaagtgacctgatcattagttagtacggtggccttttagccctcttcttttgcaacatctttgtggtattttatattgtcaacccatttactctgtggttaatgtctttccctttggcttcttgttctcctccttcttgaatacttttatttcttttttttttcctttttttttttttttgctttctaaaagaatgtttcccaaggttctggccatgcaaaatttccttcatctctctacaatttacacatgagaaccctatttatttctacatttatcattatcttcatgcatagcttcttatttttattcattgtcttggattgatttctaaattcctgaatcacatttttatctgcctgcaaggtgtcacattcgtagagtcaataaaacacttactgggttgtctattctattctatctttttttaattctcttgaccccagttttcctgacagctacgtttttctgctccccttataagataaattcctgagacagtaatctatactcactgtttctcctttcctctcatctctcttgaacccactcaagtgaggctttatcccctactactccatcacagttactcgtcaaagccatgaatgatatatcttgccaaatcaaatggtcatttctcagtcctcattttattagacttctcagcatcatttgctacagttgttcattgtctgctggttgaaaatatttttacttggcttctagaatgccatattcttctggtatctttctttaaaaaaggcggggggcaggggggcggcgggggcataaacccacaggacagaaggagaaaaaagcaagtaaattccagaaggtggaaaggagatgaacacttgaaaagcgccttaacagaaaagaatggggaattctacttcaataggggacagaccagaaaagcaacctgattgtcactgatgaacccccaaagagcccagaaaatgacagaaaaaggtattactgcaggaggagagggtgtgaagatgtgaagaaaatagaatgactggttaaaagtttataaaatcattagatttacaggtctcctacttgatacaaagttttctcacattctattagaagtctgactttcttctctagagaggctgaaacagagtattttagtttccaagggctactgtaaaaaagtaccacaaagtgggtggtttaaaacaaaataaatttgtcttctcacagttctggaggctagaaatctaaaatcaagatatcaacagggttggttctttctggaggttttgaagacaatctgttccatgcttctctcctatcttctggtggatgcctggaatccttggtgttccttggtttgtaggcacatcattctaatctctgccattctgcttacacagcattattccttgtatttttctgtgtttaactatctcccctggccaggcgcactggatcatgcctgtaatcccaacactttggaaggctgaggcgggctgatcacctgaggtcaggagtttgagaccagcctggccaacatggtgaaaccctgtcttctactaaaaatacaaaaattagccggatgtgctggcaggtgcctgtaatccctgctactagggaggctaacacaggagaattgcttgaacccaggcggaggttgcagtgagccaagatcgtgccactgcactctagcctggcgacaaagtgagaccctgtctcaaaaaaataaaaaataaaaaataaaaaataaatttctccttgtaaaaccaccagtcactggatttagggttcactctaatccagtatggtctcatcttaaattgatcacatctgcaaagaccttattttcaaagaaagtcacattcccaggtactagggattaagacttcaacacattttttcaggggacacaatttcatctactacccagaggatttatagagttggaacagtcacagtggagggtagggggatatgaactgaaaataggagaaacaggtgaggttttacaaaatttgaggaaaactttcaggcttctttcctaatttaaagaaaaccaacagctagttttatatttttcaggtaaaggtctgaaagtatcttctctagacaatcagaccagcccacaataaatgatctgaatatgctaccatcaagagttcctccaagagatcaactcagccaaataatctacagcaaagactgcagtcaacaaccccacaacctcatttagtcagggtgcttctgactgcctttttgctgtcctgatcttaaactgaagccgacagagatggatcactagacatttaagaacagctaataacatgaaagacagaatgcaaaactctgtttaaaaaagcaagtcggagaaaacactgatgatttaaaaagaaaagaaattaagaaaagttgtcattagtaccttcagagaagtctcactcatgaggcaagaagagaatactagtaaaataaaatattcaaagaacaaaagagagctgtttgaattaaatataatagcattaatataaaagttcaatagaagtactagaaaatagatttgaggaaaattttcacaaaacagagcaaaaagatgagctcaaaaagaggataaagagataagaacattaaaggaccaattccaagacatctaatatctgaacaatgtagaaagaaagaaaacaaaataaaaaagaataaacataatattaatggtaataattcttttaaaacccccaaactaggctgggcgcagtggctcacgtctgtaatcccagcactctgggatgccgaggtgggcagaccacttgaggtcaggcattcaataccagactggccgatatggtgaaaccctatctctactaaaaatacaaaaattagccgagcatggtggaaggcacctgtaatcccagctcctggggaggctgaggcaagtgtatcacttgaaactgggatgcagaggttgcaatgagccagtattgtgccactgcactccagcctgggtgacagtgcaagactctatctcaaaataaatgaataaatacataaaatccccaaatgaaaggaaattagtttctatattcaatgggtcgaaccagtgcccagcacaaagtctgaaaataactctaaccctaaagccactcctacaaaatttcagaacaatgaggaaaacaggagatcctaaaagcttccagaaaaaggtttcacacaaaaggtaccaattatacaaaagactgcatacaaatgatgaggtatcagaacaagaaagcttagaaaaatatggagcatataaagtcaatggatttgaagaggaattccaaaaactagacggcagagggagcaatgcctacaaattctgagaaaaaaaaatttataggccaggattatatacctagttgtactgttaatcaaatgttagagtgaaataaaaacattttaagacatgcaaggctctcaaagcatttttcatgcaatattagctccctgaaattcaacacaagagtggtgaataaaatctccaggatgatgaggtaaagaaaaaaacaaaacaatagctacgcagcatacccagcaacaaattgtactgaaaaggtcagaagtttctggacgagacatctaaaagataaaaatgatagaatacttaatgtgtctgaaagtattgagaagagatttacccaagtagaagttagtttgggtttaattaataataaaaaacatacaaagttaagcaagtgaataaaccaattactaactccagaagatgaaaatattgtgtaagaaaaagaaatgacagtaggctacatggctctgctgtgagtagatttttccataatcaaaaaactgtaaatgacagaaattaaacaacttgctcccgaatgacttttgggtaaaaaatgaaattaaagcagaagtcaagaaagaaattctttgaaatgaatgagaacaaagatacaacataccagaatctctggaatccagctaaagcagtgttaagagggaagtttacagtgctaaacacccacatcaaaaagttataaagatctcaaataaacaacctaacatcacaccaagaggaaatagagaaacaagagcaaaccaaccccaaggatagcagaagacaagaaataaccaaagtcagagctgaattgaaggaaattgagatacgaaaaaaaaaccatacaaaagatcaatgaatccagggattggttttttgaaagaataaatagatagaccactagctaggctgataaagaaaaaaagagaagatccaaataaacacaatcagaagtgacaaagaggacattaccattgaccccacacatacacaaaaaaccctcagagactattactgacagcaaacaaactagaaaacgtagaagaaatagataaatttatggaaaaatacaaccctctcaagattaagccagggagaaactggatccctgaaaagaccaatgatgagttccaaaactgattcagtaataaaaagcctaccaagcagaaaaagccctggaccagaagaattgacagccaaattctaccacatgtataaagaagagctggcactattcctactaaaactataccaaaaaattgagggggagggactcctccctaactcattctatgaggccagcatcatcctaataccaaaacctggcagagccacaacaacaacaacaacaacaaaatatcaggccaatatccttgatgtgcacagatgcaaaaatccttgacaaaatactagcaaacagaatccagcagcacatcaaaagctaatctaccatgatcaagtaggctttatccttgggatgcaagattggttcaatatatgcaaattggccgggcacggtggctcatgcctgtaatcccagcagtttgggaggctggggcgggcggatcacgaggtcaggagatggagaatatcctggttaacatggtgaaactcaatctctactaaaaaatacaaaaaaattcagccaggcttggtggtgagcgccagtagtcccagctacttgggaggctgaggcaggagaatggcatgaacccaggaggcggagcttgcagcgagccaagatggtgccactgcactccagcctgcgtgacagagagagactctgtctcaaaaaaaaaaaaaaaaaaaaaaaaaaaaaaaaatatatatatatatatatatatatatatatatatatatatatatatatgtgcaaatcaataaatatgattcaccacatcaacggaactaaaaacaaaaaccacataatgatctcaatagatacagaaaaggttttcaataaaattcaacatcacttcacattaaaaactctcaacaaactaggcatcaaagtaacatacctcaaaataataagagccatctacaacaaacccacagccaacatcatactgaataggcaaaagctggaagcattcccctttagaaccagagcaagacaagatgcccactctcaccactcctattccacataatactagaagtcctcgccagagaaatcaagcaagagaaagaaataaaaagcatccacgtaggaagagaaagagtcaaactatctctatttgcagatgatataattctatacctggaaaactcgattgtctctcccaaaagctcctagatctgatgaacaacttaagcaacgccacaggatacaaaatcaatgtacaaaaatcaacagcatttctatacacaaacaatgtccaagctgagtgccaaatcaagagcccaatccatccacaacagccacaagaagaataaaatacctaggaatacagctaacaagggaggtgaaagatctcaacaacaagaatgacaaaacactgctcaaagaaaacaagcaaatggaaaaacgttccatgctcatgaataggatgaatcaatattgtaaaacagccataatgcctaaagcaatttacagattcaatactattcctatgaaactgccaatgacattcttcacagaattagaaagagctattttaaaattcatatggaaccaaaaaaaagcttgaatgctcaaggcaattcaaagtaaaaagaacaaagctggaagcatcatgttacctgacatcaaactatactaaaaggctatagtaaccaaaacagcatggtactggcacaaaaacagacacatagaccaatggaacagaatagaaagtccagaaataaggcctcacacctgtaactatctgatcttcaacaaagttaacaaaaaaataagcaacatggtaaggaacacttattcaataaatggtgctgggataactggctagccatatgtagaagattgaaactggataccttcctttgatcatacaagaaaatcaactcaaaatgtattaaagacttaaatgtaaaacctaaaactataaaaaccctagaagaaaatctaggaaatacaattctggacataggccatggcaaagatttcatgataaagccaggtgcagtggctcatgcctgtaatcctagcactttgcaagtcagaggcaggtggatcacctaaggtgaggagttcaagaccagcctggccaacatggggaaacctcatctatactaaaaaatacaaaaattagccgggcttggtagtgtgcacctgtagtctcaactacttggaggctgaggcaggagaatcacttgaacctgggagccaagatcgcgtcattacactccagcctgggtgacagagtgagactttgtttccaaaaaaaaaaaaaaaaaaaaaaattcataatgaagattccaaaagtaattgcaacaaaagcaaaaattaacaaatgggacctaattaactaaggagattctgtacagcaaaagaaataatcaacagactaaacagacaacttacagaattttgggagaaaatatctgcaaaatattcatctgacaaaggtctagtgttcagagtctgtaagaaacttaaacaagttaacaagcaaaaaacaaacaactgtttttaactttgccatttaactttaactttgccatttaaagatgggcaaaggccacgaacagacacttctcaaaagacatacataaggccaataagcatatgcaaaaatcctcaacatcactaattattaaagaaatgaatatccaaaccaagatgacatactgtctcacgccatccggaatggctattactaaaaagccaaagaataacagatgctggtggggttgaagagaaatgggagtatttatacaccgcttgtgggaatgtaaattagttcagccactgtggaaagcactttggagatttctcaaagtacttaaaacagaattaccatctgacctaggaatcccattactgggtatatatctaaaggaatacaaattgttctaccataaagacacatacacgcatatgttcatcacagtgctactcacaatagcaaagacatggaatcaatctaaatgcccatcaacaacagactggataaagaaaatgtggtacatatacattatgcaatactatacagccataaaaaggaatgagatcatgtactctgcagcaacatggatggacctagagaccgttatcctaagcaaattaacaaaggaacagaaaaccaagtgccacatattcacttatcaatgggagcttatcaacatgagtacagatgaacgcaaagaagaaacaacagacactggggcctacttgagggtggagagtgggaggagggagaggatcaggtactatgcttatcacttagatgtcaaaataatctgtactccatacccccatggcacacaatttaccagtataagaaacctgcacatgtacccctgaacctaaaagtttaaaaaaaataacttgcaacatcaaatatttatctaaccaaaattataatacatctataccgagaaggtaagaatgagaagtagtgtgtgatgtgggaagcagagtcaaagagaggcaatttttcatcttccatattggagagttaacagagaatgcctaaaactggaaaaacaaaaacttcaacatacatacattatttagagatacgggaaacggtagagagaaagattaagggagcgtaggaggcagccattttaacaatgaaaactatatagttactgaccctttaaactatattcatgtaaaactctgataaaaaacaaaagtaaagttgataatgaaatgaagaactttccagtgtataaaaatcaaaccaggctgggcctggtgtcttatgtctataatcccagcactttgagaggccaagatgggaggatcgcttgagcccagtagttaggcaacatggtgaaaacctgtctctacaaaaaattcttaaaattagccaggcccacgtggtgttgcacgcctgtggtcccagctacttgggcggctggggtgggaggatcacttgagcccaggaggctgagactgcactgagccacgatcacaccactgcgttccagcatgcgtgacagagcaagactctgtctcaaaaaaaaacaaaaacaaaaacagaaacaaaaaaaacaggtacaagttaaataaatgcaagggtctggaaagattcatttcttgatgaagagagccatagtttttcttaatgatatgatcgcaggaactatgttttcttcactacattcaacataaggtacatatgttaaggatactaatgaggaattattccacagagtttagttttacttcaataaatactgcttgactttctaatatattataaagtaagaagattaaaaaaaaaaaacccaaacacatagtaaggtgcagagttttagagcatatagaggcttggtccagattaaaatgtataaacatttgttcaaatagatgaattgtcagataaaataggaagtaatcttgttttagaggacataaacaggattaataggtagaatttacagatagaaatatttcagctctaagtagagttttctcaatataagactaatcgaatttcaatacttactacagaactgcaataatctaaacaacatggtatttttataagaatagatatatagattaatcaaacaggatacagttgaaaaatcatccatatatggtcaaatgattttttacaaatgatttttgagaaaataatttggtggggaaacgacagtcatttcaacaaacggtgacagaataactggatttccatacgtaaaaacaaaaacaaacaaaactctcaactgatacctcataccatatacaaacttgaagtagaaacacagatctatatgtaaaactatagcaaaaacggtacaacttgtgaaagaaaacatagaatatcagcttgaatcaacggctcatgcctataatcccagcactttgggaggctgaggcaggaggactgctggagcccaggagcttgaggccagcctcagcaatgatgtgagactctatccctaaaaaaaaaaaaaataaataaataaaataaaaatgagctgagtgtggtggcacatacctataatcccagctactcgggaggctcaagtgggaggatcacttgagctcagagagtcgaggctgcagtgatccatgatcgcaccactgcattccagactgaatgatacagtgaaaccctgtctcaatgtgtatatgtaaatatatatgtaaaaaaaagtagatgatatatattgattatatattaccaaatattatacattattatatataatttatgtatttacatacatatttggattatatatgtatctttgtgatcttgagttaggctttttcttagagaagacacaaaaagtatgaaaagtaaattggacttcatcaaaattaatatctgctctttgaaagacactttaaagacaaggcacaggctgggagaagatataatagctgataaagaacttatatccagaatatataaacaccttttataattcaataataaggagacagacaatccaatttttaaaataggcaaaagatttgagcaaatgcttgactaacaaaaatatatagatagccagtaagtcaagacaatgttgtcatcatctttagtgatccgaaaactgcaaattaaaaccatagtgaaataccattatatacctactagaatgtctaaaattaaaaggacttataataccaaatgctggcaaggatgcaaagtcactagaacctcatgtatttgctggtggaaatgaaaaatatataccaaatttaaatagttgtacgacattatgaaggtatataacactgaactgcataccgtgagccgaggtaaaggcttaaaaattgtttaaaaaaaaggctggccgtggtggctcatgcctgtaatcccagcactttgggaggctgagacgggtggatcacctgaggctgggagttcgagaccaacctgaccaacatggagaaaccctgtctctgctaaaaatacaaaattagccgggtgtggtggtgcatgcctgtaatcccagctactcgggagtctgaggcaggagaatcgcttgaacccaggaggcggaggctgcagtgagctgagattgcgccattgaactccagcctgggcattaagagtgaaaactccatctcaaaataataataataatcccaaatggaccatagtaaaaaaaattttaaagattcaaatatttctagaggaatttaaaaaagacatatacattcactcaaatatataaaacattacatgaaaatgggaatttttaatgctttcaataagttatagaagtgatactgctttttgtgttctaaaattttgagtcaagatcagcaataaacataaaccctaatctacagagtaaaatgcaattttataagaaagacttcctaataataataacacaagatgaacataaagtttggtaaactttatggttttaagagttaaccatagctgacaagctggactgttaacacttatgaatgccaggtattcatagatggtaatactgggcacttaggtagagcttaaccttgtaaatcaactattcttccattcttcccctcctctaggcttcagctggcccaaacaggaacgtctgaaatgtaggacagtcttatctaaaatgtctcaaagaaggccagaaaggaacaacaacaacaaaaagttaggagttggagttgaagggctgtcttaaataggaggccaatactcttcagaggctagcaggaacattctgtcactgttccaagtgaaccagaggaaaatctcccttaccccgacttcaaatagtcatggctatttggcattaggagcctgtgcctctggaaaacaaggacgagctagactgaagtgcttatttttcccctgctccatggagaagtcatcagtttacagctggggagattatcaaaggtatccaaggtgagtggcctaacctatgtatgctgggctgaaactctggcaggtctaggtaaactgaggcaggtaacagggtattatatgtggataaggaagaatgaaccccctaagatagaagatcttgacataaagaagaaatcagagttcccagcctgggcaacatagtgaaactccgtctctacagaaaatacaaaaattagccaggtgtggtgacgtgcgcctgtaatcccagctacttggggtgctgtggcaggtggattgcttgatcctgggaggttgatgctgcggtgaaccgtatttgcaccaatgcactccagcacgggcaacaaagtgagaccctgtcttaaaaaaacaaaacaaaacaaaaaacagcaaagaaatcaaagtttaaaaagtagttgatcaaaaataggacacatagacttactccttccaggaagaacccaagataggcctactctgtgatagaaggtaaaaattctcagattcaaaaacactagatgaatttgacaaatgaaaacaattttgggctgggcgcagtggctcacacctgtaatctcagcactttgggaggccgaggcaggcagattacctgaggtcaggaattcgagaccagtctggccaacatggcaaaaccccgtctctactaaaaatacagaaattagccaggtgtggctgggcacagtggctcacgcctgtaataccggcactttgggaggccgaggcgagcggatcacgaggtcaggagatcgagaccatcttggccaacctggtgaaaccctgtctctactaaaataaaaaaaaaattagctgggcatggtgacgtgtgcctgtaatcccagctacttgggaggctgaggcaggggaattgcttgaacctgggaggcggaggttgcggtgagttgagatagcgccactgcactccagcctggtgacagagcaagactccgtctcaaaacaaaacaaaaaaattagccagttgtggtggtagatgcctgtaatcccggatgctcgggaggctgaggcaggagaatcgcttgaacccaggaggcacgggttgcagtgagccaagatcatgccactgcactccagcctgggcaacagagcgagagactccatctcaaaaaaaagaaaagaaataaattgggggtggaaaattgatccagggcaacctcaggcagggttgtccctgaggaaatacgttagatgtcccaaatattaacaggcggatctgagtcccttgcctgctgttggtgatactctggcagaggaacaaagtcaaatggctgcccacaaaatgtcaatggaaagctatgagtaaacaaagagaagactgaatgatgcaaaggctgaagaagtaaattaggagagaactaggatttaagaataaagccagttttacactgcatgttctgaaacattggagaaggaagataatctatcagttaaaatggtgattgatgtgcaacagccctcaaaacacagggctagaagtgagtatttaaaggaacatagtttctcttatagcccagttatcagaatcaaaacctgttactctttattttgtcatttttatcccctgtgctggcacaaaacctgaggcaacagaggttaatttataaatatccagatttactatcatgaatcctgtttttccattaaatatgagtgtacttcacaggccaaactgttcagaagataagactataaactaatctaagctgaacaagaaaggtgcacattatatatgcattcttaaaactacacatggagtttttgtaaatgaaaagctaatttcttacttattttcattatctgattgtgttttctttggcgaaagatcctaaacttaaattttaggcaaatgcagcaacagaaaagatacacagaaaagaaaacagaaaataattttcttttctctcttttttttttaagagttaaactttttttttaaatttgtactttaggtttgggggtacatgtgaaggtttgttacagaggtaaacattcgtcacaggggtttgttgtacatattatttcataacccacatattaagcctagtactcaatagtcatcttttctgctcctctctctcctcccaccctcccccttcgagtagaccccagtgtcgattgtttccccttctttgtgtttataagttcttatcatttcgctcccgcttacaagtgagaacatgtggtatttggtttttgtgcctgcgttagtttgctaagaagaatggcctctagctccatacatgttcctgcaaaagacatgatcttgttcttttttatggctgcatagtattccatggtgtatatgtatcacattttctttattcagtctgtcagtgatgtgcatttaggttgattccatgtctttgttactgtgaatagtgctacattgaacattcacatgcatgtgtctttatagcagaatgatttatattcttctgggtatatacccagtaatgggattgctaagtcgaatgatagttctgcttttagctctttgaggaatcaccatactgctttccacaatggttgaactaatttacacttccaccaacagtgtatgtgtttccttttctccgtaaccttgcccacatctgttatttttttgacttttcagtaatagccattctgactggtgtgagatggtatctcactgtggctttgatttgcatttctctaattatcagtgatactgagtttttatatgcttgttggccgtacgtatgtcttcttttgagaagtgtctgttcatgtcctttgcccactttttaatggggttatttttctcttgtgaatttttttaaatttccttatacatgatggatattaggcctttgtgagatgcatagtttgcaaatatttttctctcattctgtagattttctctttactctgttgacagttttttgctgtgtaggttgtaagtttaattagatcccacttgtcaacttctgttttcgttgcaattgctattggtatctttgttatggaatctttgtccactcctgtgtctaggattgtactgcctagattgtcttccaggctttttatagttttgggttttacatttgagtctttaatctgccttgagttgatttttgagtatggtgtaaggaacaggtccagtttcaatcttctacatatgtctagccagttatcccagcaccatttattgaacagggagtttttcccccatcgcttgatttttgtcagatagtcatagatgtacagccttatttatgagctcactattctgttccattggtctatgtgcctgttttgtagcagcaccatgctgttttggttcgtgtagccttgcacacccaaaagctcctctatctgataaacaacttcaaattggcaggatacaaaatcagtgtacaaaaatcactagcattcccatacaccaacaacagccaaaccaagagccaaatcagaaaggcaatcccactcacaactaccacaaaaagaataaaatacctaggaatctatctaaccagggaggtgaaagatctctacaatgagaattacaaaacactgctcaaagagatcagagaagatacaaacaaatggaagaacatctcatgctcatggatacaaagaatcaatatcattaaaatggccatactgcccaaaacaatgtacaggttcaatgttattcctatgaaactacgagtggcattcttcatagaatttaaaaaaactattttaaaattgatatgaaaccaaaaaaaaagccccaatagccaaggcaatcttaagcaaaaagaataaggctggaggtatcacattacctaacttcaaactatactacaaggctagagaattttcatagcagtactattcataatagattaaaatggaaacaacacaaatgttcatcaatactagaatggataaattgtgccatattctttttttgagacggagtctcgctctgttgcccaggctggagtgcagtggtgcgatctcggctcactgcaacctccacctcctgggttcaagcgattctcctgcctccgcttcctaagtagctgggattacaggtgcccgccaccatgcccagctaatttttgtacttttagtagagatggggtttctctatgttggtcaggttggtctcgaactcctgaactcatgatctacccacctcaacctcccaaagtgctgggattacaggcgtgagccaccggtggcatattcttgatatagaattccatatagcaatgagaatgaagtatttacaactacacaacatgacaagataaagttaataaacataatgctcagtgaagaaagccaaacacaaatgagtgtacaacgtgttattctatttgcataacgttcagaaacaaagtatccaatgatgtacaaaggcagaacagtagtttggagatgagggaacagtgactggaaaaaacataccataaacgtcctggatttgggcaatacatatttccagtttagatgctggttatacaggaatgttccatttgtgagcaattcacagaactgttcacttatgatgtgggccctttctgcacatatgatatactttagtaaaaagcttactttaaaaaatcaagaagagactttctaaaggattttaagtttaaaattattttttcatacaaaataaccacactctgagttcataaatttcaattctcataaaaaacatcctattgctacaaaatataagagaatctaatatagttaatttggtgtgtcaacatgactgggctaaaggatgatgagatagctggcaaaacattatttctgggtatgtctgtgaggatgtttccagaaaagattatccctccaatcagcagactgtgtaaacatccactctcaccaatgtgagtgggtaccatctaatcagtggagagtgtgaatagaaaaaaaggtagaggaagggtgtatctgatgtctgcttgagctgggaaatacatgttctcctcctctgggacatgtgtgctcctgattcttgggccttccgacttggactaaatatcaccaccaattttcctgggcctccagtttgctgttggcatatcataggacttcccagtctccataattgcttgagccaatccctcacaatgaatctcttcctatatctctctctatatactgttggttctgtttctctggaaaccctgactaacatggaaagcaatattttcatgtctatacattttttattgggaggctgaggcgggtggatcacctgaggtcaggagttcgagaccagccttcccaacgtggtgaaactccgtatctactaaaaataaaaaaattagccaagcatggtggcgtgcacctgtaatcccagctactcagaagactgaggcaggagaatcgcttgaacccaggaggcagagggtgcagtgaaccaagtttgcaccattgcactctagcatgggtgacaagagcaaaaccccgtctcaaaaaaaaaaaaaaaaaaaattgttaattgtatttcctggccatagttcctatttttaaaaagacatagtacggaagagcttatagtaaagggcaactgcctccatcttgatcccttctcacctcaagtcccaatcctactcctgaagacaaccttgataatcttaaataatgtacttattttacaactccattatgtattaactgaagacattatctgttgacttctgtggaaagagaaaatcataagtccatgttcttaaatctcaatctgactaaaaaaatatctctgaggccagaacactgggctctaatgaacatctctgaggccagacagagcactgggctcctttaatgttaatgaagaacttttaaaaagatgagactgattttgaaaactctgcaggtgattcaaatgcacaatcaaggctgatacaggctgagtcagataaaaaaggagaaggctgaaatatatttaccttaccttctaattactataaaatttaaagtaaatccataattattttgtacgttatattatctgtatttgctaatgtatagcaaatatggatactataagaaattttaaaagttgagcttcttcctaagttttttgccaagaaaaacaaatgacaggttccaaggactactagcatgtaactttgtatctaaggtctgtcagaggaaactacatttgttaaagtatcttttatagaatactttgcctatgcactaataaatgtcaactgtgtttgccaaatgaagttgattttaacatccagataataatttattcataacgacctcattgatctagctctaattaactcaatctatataaaaaaagatgatacagattctcataaaattaggaacatgactaaagggacatttcctctttgcaagtaaaataaaataactaacagattaactttgaagcaaaatgcagaatcttgttttgttaccacatcccactataagagatttggctttccactaaaaaaaaattttggtccacttccagcacccttctacctcacctcccccttcattttcacaatgataatagttataagaatgactctaccactcatcacattcgtgattttagaaaatatatttaagattctaggactatttctgtgaaatttagctttatggttctcaaatttgactacacactggaatcacctggcaaactgaaaacaacaaacagatacctagctttccctgccagcaaagatttttatttaactggtataatgcagtttgatgaagtttggggatcaagattttgaaagcttctcaagtgattttaatgtgcaacgaagtttcagaaccactacataggatgaagatttttagtagcagtgaccatgcctttcgctcacaacttctatcacctgtacctttaaaaaacatttttcaggctgatgcaatttatgttatattctagaaccataattaagactgccagactttggatatatagctaattctaattaaaaaatcaatacacaatgtagtctcaggatttatgtattgttcagagcagaaccaagctgtgctctcaggttatatttcttccctactatctacatcaaggccaggagaagtttcttatacttcaaaaattcctcaaaatcatattacttttaatctacataatgtttttggacactaactttcttatctagttattttgttttcctgaactttctgaccatctctcttgagataagaaataaatatgtctattttaccacagtccaatatggtgaaaccccatctctaccaaaaatgagaatcacttgaacccaggaggcagaggttgcagtgagctgagattgcgccattgcacaccagcctgggcgacagagcaaggaaggctctgtctaaaaaaaaaaaagcatatacagattttcaactgcgtgagggaccagcactcctaactcttacattgctcaacagtcaactgtgcaagaaggatgctatatgctattgctggcttgaagatgggggagcctatatggtaagaaatgtggatggtccttggaatctgagattgagccaggctgacagcaagcaaagaaacaggcacctcactcctacaactgcaaggaaataaattctgtgaacaaaaagaaggagcttggaaacagattttttccatggatcctccagatgagaactcagtccagctaacactttgattcagccttgtgatattctgagcagggtatccagccatgccttgccagacttctaacctacaaactgtgagtgacaaatgggtatcattttaagctactaagtttgtggtaatttgtatgcagcaaacggaaactaacactgggatcccaaacttatgagaacaaataattagtgaatttgatagagcaatagaaattatccaatctgaggtacacagagaataaaaggtttaagaaaaatgaatgaagcctcagacagagacctttgggacaatgcaaagcatcccaacattcatataatggaaggcccagaaaaagagagaaaggggcagaaaaaaaaatacggaaaaatcagggtccgaaacttcccaaatctgaagaaaaacatttactctcagacccaagaagctcaatgaatcctaagtcagataaacacacaaaagaagcccacatagatacatcagggtcaaactgtttaaagatagagacaaagaagaaatattaaaagcagaaagagaaaaacaatttattatgtactggaagcaatgatactactaggggctgacttttcatcagaccaacagaggcaagagggcaaccgaatgacattcatggtgtagaaagaaaaaatactgccaaccaagactcccacatccagcaaaactgcccttcaaaactgaaggtgaaacaaagacattctcagaaaaacaaaaactgagagaatttgttgctggcagacctttcctacagtagttttatatatgtttcacaacggtaaatatttaagtatatattaatataaatataaatgactgaatacacacatgcatacacatatttttcttttttctctttatttaaaaaagatttaaaatgaataattataacactatattcttacatataatatatacttgtataatacaataccacaaagggaaagaaatagagtgatactggaatgaaacggctatattttaccagaattaagtcagaattaagtcaatgttaaactcaagtagactgagatatgttaaaaatatgtattataattcctagagcaacaattaagaaaaaaaactttttaaaaggctaaaaatttacattggtaagcaaaaggcatttgttttaacacaaaagaatggagtcaaagagaaacagaggcatcatctctgcagcaatctccctaaaagtccatcatctcagtctaaagtgaaggaacataagacaaatccgaaatgagggacattcaacaatgagggatatatcgccatatgtagaaagctgaaactggatcccttccttacaccttatataaaaattaactcaagatggattaaagacttaaatataagacctaaaaccataaaaaccccagaagaaaacctaggcaataccattcaggacacaggcatgggcagagacttcaggactaaaacaccaaaagcaatggcaacaaaagccaaaatagacaaatgggatctaattaaactaaagagcttctgcacagcaaaagaaactaccagcagagtgaacaggcaacctacagaatgggagcaaatttttgcaatctacccatctgaaaaagggctaacatccagaatctacaaagaacttaaacaaatttacaggaaaaaaacaaataaccccatccaaaagtgtacaaaggatatgaacagacacttctcaaaagaagacatttatgcagccaacaaacatacaaaaaaatcctcatcatcactggtcattagagaaacgcaaatcaaaaccacagtgagataccatctcacgccagttagaatggcgatcattaaaaagtcaggaaacaacacatgctggagaggatgtggagaaacaggaacgcttttacactgttggtgggagtgtaaattagttcaaccattgtggaagacagtgtggtgattcctcaaggatctagaactagaaataccatttgacccaacaatcctattactgggtatatatccaaaggattataaatactactactataaagacacacgcaaacgtatgtttactgtgacactattcacaatagcaaagtcttggaaccaacccaaatgtccatcaataatagactggataaagaaaatgtgggctgggcgcagtggctcatgcctgtaatcccagcactttgggaggccgaggtgggtggatcacaaggtcaggaagtcgagaccatcctagctaacatggtgaaaccccatctctactaaaaatacaaaaaattagccaggcatggtggcgggcgcctgtagtcccagctacttgggaggctgaggcaaaagaatggcgtgaatctgggaagttgagcttgcagtgagccaagatcccgccactgcactccagcctaggctacagagggagactccatctcaaaaaaaaaaagaaagaaaaagaaaaaagaaaagaaaagaaaatgtggcacatatacaccatggaatactatgcagccataaaaaaggacgagttcatgtcctttacagggacatggaagaagctggaaaccatcattctcaaaaaactatcacaaggacagaaaaccaaacactgcatgttctcactcataagtggcagttgaacaatgagaatacacggacaatgggagtgtcgggggggacacatcacacagtggggcctgtcagggggtggggggctgggggagggatagcattaggagaaatacctaatgtaaatgatgagttgatgggtgcagcaaaacaacatggcacatatatacctatgtaacaaacctgcacgttgtgcacatgtacctcagaacttaaagtatttaaaaaaagaaaaaaaaaagtacattagtaagcaaaaggcatttgtttaacacaaaagaatggagtcaaagagaaacagatgcagcatctctgtggtactctccccaaaagtccatcatctcagtctaaagtgaaagaacatcagacaaatccgacgtgagggacattcaacaaaatactgatcagtacttttcaaaaagtatcaaggtcatgaaggataaggaaagattaagaaactaccacagaatgaagagactaaaaagacacaataattaaatgcaatgtaatatcctgtattggattaacaaaataaagtaacaagtcacagactgggagaaaatattttcaaatcttgtatttgataaaagctatgtaagaagaatatataaagaattctttaataagaagacagacaacccaattaaaacttaggtaaaatatgtgaatagacaattcactagagacaatacttaatggcaaacaagcacatgaaaagctgttcaacatcattacttacatggaaatgcaaattaaagccacaatgtaatacacattattagaatggctataatcaaaaagacaaaaaaaaaagcgctgataagaatgaggagaaactggaaccgtcatatgttgccatagggaatgtaaaatagtatagccactttagaaaactacttggcattgtcttaggaggttatataatatatacagttaacatacaacccagtaatcctactcttagtttttcatgccagagaaatgaaaacaaatatccagaattgcatgggaatgttcataacagctttatgcataatagccccaaagtggaaaaatacaaatctccatcaattagtaaatttataaacaaaatgtagtttacccatacaacaaaatactcggcaataagaaggaacaaactactgatttatacaacaaggatgaacctggaaagaaaagccagacacaaaagattacacagtttgccagagagctggtgactggaaaaaaataggaaccccccaaaaaaagattagacagtatattacttcaactacgtgaaatttatagaaaaggtaaactgtaaagaaggaaaaaaagcaacatcatttgttgactaggtctggaggtggggacaaggattgactgagtacaaagaggcacaaactttttggtaaaacggaaattctaaaagaattctagtgatgctaaaactgatcaaactgtgtatagtttataacacaaattatacagttatgtgttaattttttatatgtagattatactgcaataagctattaaagcggtaggcgtgggcggggagggtacaatcaaaaagaagaaaacatatgtctcaaattatgctaatagttttgataaaataagaaatgagcaatgatcactggatttagctactctggggagtattagtagcctccgtaagtgtaattttggtgttatggttagcatgaaaacccaacaacaataggacctgaaaaatggaagcaacaaatacacataattattacatggaattttgcagtaaagaagtaaagaaatatagtggtaactggaggagaatatgcagtcaagagtaggctggtttggttgctttgtttttaaagggaaaaataggccgggcatggtggctcatgcctgtaattccagcattttgggaggctgaggcagatggatcacttgaggtgaggagttagacatcagcctggccaacataatgaaaccccatctctactaaaaatacaaaaattagctggtcatgttggcaaactcctgtagttccagctaatggggaggctgaggcaggagaatcgcttgaactcgggaggtggaggttgcagtgagccaagatggctcactgcactccagcctgggtgacacagtgaaactccatctaaataaataagtaaataaaggggaaaatagtgtgcttttatggtaataagaacgatcaatagagaatggattgagtgggagaaaatctatagaattgccagagcaatgttcttgagtacataataggaggcaatggttgaaactgcatgacaagggccaggtgcagtggctcacacctgtaatcctagcactttgggaggctgaggcgggtggatcacaaggtcaggagttcgagaccagcctggccaagatggtgaaaccctgtctctactaaaaatacaaaaattagccgggtgcagtggcgggtgcctgtaatcccagctacacgggaagctgaggcaggaaaattgcttgaactcaagaggcagaggttgcagtaagtcgagattgtgccactgcactctagcctgggtgacagagcaagactccatctcaaaaaaaaaaaaaaaagaaaagaaaaacaaaaaaaattgcatgacacggcctggtgcagtgactcacacctgtaatcccagcactttgggaggctgaggcgggtggatcacatgaggtcaggagttcgagaccagcctggccaacatgctgaaagcctgtctctactaaaaatacaaaaacttagctgggcatagtggtgagtgcctgtaatcccagcaacttgggaggctgaggcaagagaatcgcttgaacccaggaggcagaggttgcagtgagctgagattgcgccattgcactccagcctgggcaacaagagcgaaactcaatctcaaaaaaaaaaaaaaagaaagaaattgtatgacagaatcaacagacggatagttcatccagggtattaggggagacgataaaatacaggggtaaaaaagcagagacatgagtagatatagagagcttataatacttcttgtctgatagcttcatttccttggaaacggaggaagcagtgtcatcaactgggtgttaagatgcaggaggaggtgttagaaatttgaggacatgggagaaagaaagaaatagttgtcatggagaatgatagagaatgaatagtgcagtatagtatgactgccagccagagcatggatttaaagctagaataattggcaggtttttctccaaccaccattagaagtacgggcatacaggaacaagcttgatgaaaagtcggatttaaccagaactgtcctagccacatgaggacagaaaataagaaggagcaagaaatttgagagtgtatttgaggaaagtattagaatgattaaccatggaatttaatctaggtatgaagaaaagaggctatcaggagagtgagagactgtgcaaaggtgtagcgtttggaaggatcaatagattgtaggtcctggtagtgttttgactaattgttggaactggagtagaaaaggtgtgagctggaaaaataagacgtgaaaattttccttatgaaatttatttgataattccttcaatttaatgtttaattttcctattttattttctctttatgaagtatctcttagctatgtgtttaacctcttgggttgttctgtttaattttctttcctctatttttctgtctttttaggttccttgtttcaaccctttttattttattttatttattttttgagagactctcgctctgtctgtcacccaggctggagtgcagtggcacaatctcagctcactgcaacctccacctcccgggttcaaatgattctcctgcctcatcctcctagctaggattacaggcgcgccaccaaacctagctaatttttgtatttttagtagagatggggtttcaccatgtttgccaggctggtcttgaactcctgacctcaggtgatctgcccgccttggcctcccaaagtgttgggattacagacgtgagccactgtgcctggccaacactttattaagttttaaaatatcaagaatcatacttttgatttataagagctctttcttattctcagcctgttcatttttcatagccatttttcattttataaatgctgtggcttttcagcattctctatgtttctcagaatattttttctgaagtatcttatgttccctgaataatctgcttcttctgaggacagtctccctctttcaaaatgctcatttgcttcctatgatggatgatcactggtggttcagaatgaaggggtggacttataattctaggtaatatgttgtgttttatcccttctgctgttggatatgtagaaaaatcagctgctaggtccactaagtttccttctattttgtactctgggctggaactacctctttttctatttcagctgtcagcaatcttcagtaaatttgctgaaccttttcatctacaaatgaccagtctctcttcactatcatgggtttattttttatacttataatgagttttaatgagattttgagagggaaacaagggaaatgacagtggttacttattctaccattttgtaccagaagccatattctttttattttactgaaatgtattcgactagaaagcccatttagttagagtaattttggaaactctagagtattgtacaaagatgaagagttgccatagttttgcctcctggacagaacagacccgacttcccaaatatgtatgctaaattacaaaggaaaaggaaatacttgagctcctttaatatttagtattttagagttcttgtttttggccaaatctccaggtctatcgggcttaagcaagattaaaagaaatagaaaaatacacaaatagcctaagtagataagaactaggcattatgattcatgatctttcctcttttaacaaagatttcctgcgctctcagctgcacaccaattttaatgaaaaccactcttggcaattaattgttgagttgacatcaataaaatgttgacatttatctgaacagccgctatacatttactttgaaaaatctcaaagtaatcttatgatgaaacttcaatcacatcaatctggaattcagtctctttgtaaagtaataaaagatatttcagttgaacaacagttggaaaatactaagacattcactataacacaaattattagcaatcacatgcaaaacacaagaaataggagtaaagactttatgccaattgctgatgtcctccataaacacatatgagtgggcaaattattcattaatgataaaaatgagaaggaattaatgtattagtctcaaaaggcagacttcatgcactctgattaaagactaataatgatttataaggctcaaatggaagccagaagaatgctggccacaggtacttcagatatagacaaaagagctcacaaaaaaactttgtaaagaaggggagaggacccaaaattgtatgtgaaatgtgtgtatacatgtaaacatgcacatgaataatagctaactgtggcagactgtactgtctaaaaatggctgcaccaatacttcccatcacacaagttcttcttgcaaggtgacattgaccctcatcctactaagagaggagtctatgtttcctcctctggagattatgtgggcctatgactaaaatagaaataacctagtacattgtaatactaggtgattacaactacactgtaatactaggtgatttctgaagctgtcataaaagatagtcttcccacttgatcctcttgggatgtttgttcttggaattcagtaaccatactatgaggaactaaagagatcaaatgagggtgtccatagcaccaggtgagattccagcaaagaacctaaatcaactgacagacatgtgactaggaaagcctcaaagatgacaccatccaatacaattgcaatgagaaatcccgagtgaacccagccaaacccctgaaccattacagataataaaacaagcaatggtattttaagagttgttttggctgggcgtggtggctcatgtctgtaattccagcactttgggaggccaaggtgggcggatcacctgaggtcaggagttcgagaccatcctggccaacatgcggaaaccccgtctctactaaaaatacaaaaattagccaagtgtggtggtgggcacctgtaatcccagctactcgggaggctgaggcaggagaatcacttgaatccggaaggcagaggttgcagtgagtcgagattgctccactacactccagcttgggtaacagagtgagattccatctcaaaaaataaaaaataaaataattggaacaataataatcactgagtaactcatctgtgccaggcactgtgccaagtgctttacaaataccattttattttatccatataactatttaataagtaggtttattatcatccccatttctttctttttttgaggcagggtctctctctatcatccaggctacagtgcagtgacaaaaccttgggtcatcacagcctcgaactcacagactcaagcaatcctcctgctgcagcctcctgagtacctgggactataggcaaagacaaccatatatgactaatttttgtatattttgtagagacagggtctcactgtgttgtctaggctggtctcaaactcctgggctctcagccacccaaagtgctgggattgcaggcattagccatggcacctggtccacattttgtaatgagtaaaatgagattaacaacggttaattaagtccacaataagtggtagagctgataatgaaaccaacatctgtctccttccaaaggtggagtctcttgcaatagaaattttattttagaataacttgtttattctgggaggcaaagcttgcagtaagccgagatgacgccactgcactccagcctgggtgacagagcactccgtctcaaaaaaaataaacaaataaaataaaataaaattaaaaaaaaaaaaaagaataactcgcttattgagagcttatataacaggcaatatttgaagcacttcatatgcattaactctattaatcctcaaaaacaccctatgatactaaaaaattttatgtttctattatagattaggaaactgaggctcagagaggttaagtaacgtatccaaggtcaaacagctagtagtagaagacccggcatttaaactgaagcaattgagcttcagagccttctcatactgcttttacgagactcttaaaactatagaaagagttctagccaagagagtaacagactggatttaaccctctatctaaatctgaaaacaaagaaacaaaaaaaaatgcaaaataaacaatgggttttaagacactggacatgagacaacaaaggccagtgatccttgaaagacagaaatcaaaagacgttagcctatgaaagccaaagagtaagcctagagaagagctttcaggggggacccagatggagcctcagaatatccagtctctgtgagttgaagagggggagctgagcatctgggaaggccaagacaattaaagttcacatgagagagatatccatatctactacatccaaacatcccttcaagtctttagcctagtactcttcaatgcatgccagtgagcaaactaccaaagcacaggtaaagaatcacttgaaagatttgagggaacaatctccagaccaggaattgtttctgctcataattcacacagaatattgtgtactcagaagagtttctgccttcacagtggggcaaaatcatctttaaattaaatactgctttagtcctatttgacgaaagttaaagagccaggccctaaaggatcaaaccgtttctaagtaaactagctatgtcctagaataaagctcaacaatattcctatgaatattaaaaatttccaacactaacatggaaatatataccatgtctggcatccagtaaaaaattactggccgggtacggtggctcatgcctgtaatcgcagcactttcagaggccgaggcagacagatcatctgagatcaggagttcaagagtagcctggccaacatggagaaaccccgtctctactaaaaatacaaaacttagccaggcaaagtggcacatgcctgtaatcccagctacttgggaggctgaagcatgagaatcatttaaacctgggaggcggaggttgcagtcagctgggatcacaccactgcactccagcctgggcaacagagcgagactccatctcaaaaaaacaaaaaaacaaaaaaaaaacaaaccactaacactaaaaacacctgatgagctaataaaaacagaaacaaaaaatcacacacacacagaaattaccaaccacacaaactccaggaaactgaccaacaatgaggaggaaaaccaatcaactaaaaccagtagtttaaaccactagaaggatattaaaactgttactaattacagcattccatatgtagaagaagctagagaaaatgacttagcatgtttgagatatgtgacgcacaaaaaatccaaactaaacttctagaggtgaaaactagaatgtctgaaaaagataaaaatacatttgatatggttaacaacagataagacattgtagaagaaaagattagtgtacttgaagacagagcaaaacatccaaaatgaaacagaagggggagagaagtcaaaaaatataggaaaaattataaacatttgtattagtctgtattcatgctgctgataaagatataccaaaactgggaagaaatagagttttaattggacttacagttccacatggctggggaggcaaaaggcacttcttacatggcagaggcaaaaggaaaatgaggaagcagcaaaagcagaaacccctgatgaacccatcagatcttgtgaaactttattcactatcatgagaacggcatggaaaagaggcccccatgattcaattacctccccctgggtccctcccacaacacatggacattctgggagatacaattcaagttgagatttgaatgggtacacagccaaaccatatcattccccccatggcccctccaaatttcatgtcctcacatttcaaaaccaatcatgccttcccaacagtcccccaaagtcttaactaatttcagcattaacctaaaagtccacaatccaaagtctcatctgagacaaggcaagtcccttccacctatgaacctgtaaaatccaaagcaagttagttacgtcctggatacaatgggagtacaggtatggggtaaatacagcagttccaaatggaggaattggccaaaataaaggggttgtagggcccatgcaagtctgaaatccagcagggcagtcaaattttaaagctccaaaattatcttgtttgactccaggtctcacatccaggtcatgctgatacaagaggtgggctcccatggtcttgggcagctctgcccctgtggctttgcagggtagagcctccctcctggctgctttcatggactggtgttgagtgtctgcagcttttccaggcacacagtgcaggctgtcagtggatctaccattctgggttctggaggacggtggctctcttctcacagctccactaggcagtgccccagtagggacactgtgtgggggctccgacccaacatttcccttccacactgccctaacagaggttctgcatgggggccctgcccttgcagcaaacttttgcctgggcatgcgggtgtttccatacagcttctgaaatctaggcagggattcccaacctcaattcttgatttctgtgcacctgcaggctcaataacaaatggacactgccaaggcttggggcttccaccctctgaagccatagcccaagctctacagtggcccctttcagccatggctggagtggctgggacacaagacaccaagtccttgggcctggcccacaaaaccattttttcctcctgggcctccaggcctgtgatgggaggggctgctgtgaaggtctctgacatggcctggagacattttctccatggtcttttggattaacattaggctccttgctacttatgcaaatttctgcagccagcttgaatttctcctcaagaaatagatttttcttttctactgcatcatcaggctgcaaattttccaaacttttatgctctgtttcccttttaaaacggaatgcctttaacagtacccaagtcacctcttgaatccttttctgcttagaaatttcttccgccagataccctaactcatctctctcaagttcaaagttccacaaatctctagggcaggggcaaagtgccgtcagtctcttcgctaaaacataacaagagtcacctttgctccaattcccaacaagttcctcatctccatctgagaccacctcagcctggatcttattgttcatataactatcagcaattttgtcacagccattcaacaaatctctaggaggttccaaactttcccacattttcctgtcttcttcagagcccttcaaactgtttcaacctctgcctgttacccagttccaaagtcacttccacatttttgggtatcttttcagcaacgcccaactctactgataccaattattgtattagtctgttttcatgctgctgataaagacatacccgaaactgggaacaaaaagaggtttaattggacttacggttccacatgactggggaggcctcagaattatgacaggaggcgaaagccacttcttacatggtggcagcaaaagaaaaatcgggaagaagcaaaagtgcaaaccccgataaacccatcagatctcatgagacttattcactatcacgagaatagcatgggaaagactggcccccacgattcagttacctcccactgggtcccttccaggaagaacatgtgttaataggaaatattggtgcagccatttttagacagtacagcctcccacaacacatgggaattccaggagatacaattcaagttgagatttgaatggggacacagtgaaaccatatcaacattcatattatataaaaacattgtttcggagcctttcacaaatagtgaccaggctctcattattaatttattgggtctctcactctctctctttttaaatctttaatttttttttaatttaataatctgaacagctttaggaatacaagtgatttctggttatatagattaattgcagagtggtaaagcctgggcttttagtctactatacacccaaatagtgtacactctacccaaaagatgacttttcatccctcacccccttcccatcctcccctttctgagtctccaaggtccattataccactctgtatgcctttgcatacccatgacttaacttctacttataagtgagaacatttggtatttagttttccattcctgagttacttcacttaggataatgacctctagttccatccaggttgctgcaaaagacatttttcattctttttcatggctgagtagtattccatggtatatacataccacacttactttatccactcattggctgatgggcacttatgatacttctgtatctttgtaattgtgaattgtgctgtggtcttgggtctctctcaatgcgctactacaatttagaatggagaatattaggagagcaaattttccattcccattctccaaatccaacagtcttgctatttttttatttcagccaacaaaagaggcaccagaaaccacagaacaattatatacaagaggtatatataacttaggctgggtcaagaagaatacacaaatgaaaactatctttatgtcaatgacctgctcaaactctttcagtgtgcctggccactgaatgggatcacaatgccttcttatacttttttttttttttttttttttttttttttttttgagacggagttttgctcttgttgcccaggttggagtgcaatggcacgattttggctcactgtaacctccacctcccaggttcaagcgattctcctgcctcaccctcccaagtgactgggattacagaaatgtgccaccacgcctggctaattttgtatttttactagagacggggtttcgccacgttggccaggatggttttgaatccctgacttcatgtggtccacctgcctcggcctcccaaagtggtgggattacaggcgtgagccaccatggccggccgacttcttacactttctaactacaagagtttctttttcaaccttctagttcaccctccaaatgactccatactactactgaggccaactattgatttttttcttttttttttttttttttttgagacggagtctcactctgtcccctaggccggagtgcagtggcgcgatctcggctcactgcaagttccgcctcccaggttcacaccattctcctgcctcagcctcccgagtagctcagactataggcgcccactaccacacccagctaatttctttttgaatttttagtagagacggggtttcaccgtgttagccaggatggtctcgatctcctgacctggtgatccacccacctcggcctcccaaagtgctgggattacaggcatgagccaccgcgcccggcccaactattgattttttaaaaatttcagcttgccagtatctctagttgattattgtttatggataaaatattccacatctctaaaggattaaattattccaaaatctactttgcttatttccttgaattaattttatttgtttagttcattgcctgtcatgatactggctttggagatttttctttttttgtcattattttttgtgagaattacattcagctggtatgttgattagggtagacttggctatatagcaaatagactccaaaacatgtaagaattcatctgaaaaaggaatttatttcctaatcacatagtagtaggagaaggtgttgctgatttgcaagcagttctcctccatgtggtaacaggaatccaggccccttacatcttgaggttttgccaacacctaggttctccatctagctggcaagggggaatagcaagaaaacacatgtgggaagtgtcttctgctaatatttcattggctagaactcagtcacatggccttacattacctgtaaggaaagtagggaaaagtaggctagctatatcctcaataagagtaagaaacaaattttggtgaacagctaacagtgttgtcatagccattctgttaaagcactattcatgacaatctatttttagagaagagatgggaggtgctttggagtagactgtattaatagttaattttatgggtaaagtagttctcattcatcccgagaatgccagccatgggaagctgtggtgatctttccaaaggaaccagaaagccacacttactgattcatctgaagttagattgttacattactagatgcctgcccaaagaattttttacgtggatacaaagtacaggattggggaacagtctattcctaaagaacctcaaattatcactctactgactgcctctggatctcattctcatttaagaatctaccacctctgacagcagaacacctttcaaatggtctctaaattctgaaatagagaagactgtaggaggggcaggattgacaaggaaattagtaaattcaatattttcaatggaaatataattcacttgccctgaaattcactcttttaaagcatacaatgcagattttaatgtattcacaaagttgtgcaatcatctatctaattccaggacatttcataaatacgccatcatacaataagtggcctcttgtgtctggcttccttaactcagcatgatgttttcaaggttcatacatgtgatacagtgtattagtattccatttcatggatactagtccattttatggattcagcacatttgtttgtccatgactatttggcttcattctacttttaggataacatgaaaaatagtgaaagaccaaatgtatacatgtttttgtcaccatatattctcaattttcttgggtacaatacatctacaagtggaagggctggattatgtggtaactttatgcatacctttgtgaggaactagcaaactgtttttcaaagtggctgcactattttacattccaattaggagtgcatgaggatttcaattaatccacatccttgtcaacacttactattgtctttctttttgattatagccatcctcatgggtaagattaaagatgttcagcatcttttcatgagcttattggcaatttgtatatcctctttggatgaatgtctattcatattttttgcccattttttcattgagttatcttattattgctgagttataagttgtttatatatccttgatacaagtcccttatcagaaacatgattttcaaatatttgttcctagtctatgggttatctttacactttattgatgatgcccgtctattcatatcctttgcccattttttaattgagttatctttttattgctgagttataagttttttatatattcttgatacaagtcccttatcagaaacatgatttgcaaataattgttcctagtctgtgggttatctttattaatgatgtcctttaaagcacagaagtttcttaatttaatgaaattcagtttatgtacttttaatttggttgtatgtttttaggtgtcatatctatgaagccactgtctcctaccaagtcacaaaaatttacacttaggttttctttcaagttctagctcttacatctttgatctattttgagttaatttttgtgaatagtgtaaagtaggggtttatacttcgtacttttgtatgtgagttaactattgttgcggcactatttgttgaaaatactgttctctcccccaatgagtaagcatacttgttgaaatcaactgaccataaatgtatgcttttatttctagtattccactgatcgtgtgtatgtctctctttatgccagtacttatagtcttcattcattactatagctatgtagtagtttcaaaatcagaagtatgagactttctcaaaattgttttggctatcttggatcctttgcatttcatatgaattttagaatcagcttgccaaggctgcaaaaaaaaaaggcaactggaatcttgatagctattacactgaatgtgtaatatcagttgattttagacatgctgcatatatgtctaccagacatgcaaaaaagatgttacatttagaattcagagaaaaatgatcacatttattacataccacgttaaccacttatgaaattggtacttcagggacactgaactctactgatgacagaggaaaatcattctaggaataaaaactatttagaatcagaaaattcttccagacagtccctagatctaagtcgggggaagaaaacaacaaaaaagtttatgaggagacacagagatctattctaatccacccagtactaaattcaatagtatcactaatattcctatatttttaaattgagttgtagggtgatatgtgctaaatttattattttgctattgtagaaacagtaccttacatacattactttgactataatcaaatattcccaaattataaaaagggacagaaagaaaaaaataaaactctgatcaaagcaggttaaatcactgctcaaggtcagacacctaactaatattcaaactaaaacaagaacccaggtctcctaactcccaaagacactgtggtttgtagattataagctaacttttttgaaccctctcttcccgtcatgatacttcttatcaccttcttttgggtaactgataaaaactaaatgaaagtgatcctgactatttcttacatatgtgacagactcccagactgtcacagttcagaccggcctaatactgtattaatggaattggtagctatgcagaaagcataatcattcgactttgtcaattctttctgcctcattcttctcttaaacataagactactcccatatacatgagatatttggggctacaaagtcaccaataggcttctaaaactcatctcttcatctcattttaatacactttcagcttactgagacaatgtcagtgcccagcttgcctagtaaaatttgaagctcaaatcaaagcacaaaggaagaagcataccatgcccagagaagaaagaatattactataatttcctcttattataaatgtcctattactattctgtcaaagaaagaccctaacagaagaaattaggattctttgctccaatgaggaattttatcactgtctttgatttttttaaagcaattgtgtatctctatctgctttttaaaatctgaaaaacataaaggtctaaaaaagtaagatatacacaaagaaaaaagttttcatccagttccagagcttaacatatctagaaattctccttatgaaacaaatcttctaacaacatagttaactttagagggatctattcagaatgacaacataaatttctggggtaccaactctgaaaacaactaagaaaaaggaatctttgggttgatatatttatattaatttgacagcagccaaaagattaaaaaaataaaaatagaaaaatttcaagtaacaaatctttcattgattcatcctaaatattaaagtctaaaactctggttctgaagtatttttttcctgtcaatctcattctcatgggtacttcactattatcagtaagatttcccattatacaaagtaccttgaaacagaaagagaaacacatcagaatattcaagggtgtaaaggtggtgaatggggcaggggtagggggtgtggaaagagggtcaggatgtgcgaaatttttaaatgtcccttcctgacttggctcagaattgctatttgacaatgttttacacctgtagctgcaagaagtccttactccaatggtgacttttagtttaatttttctgtttactgcttaaatattagcaaactttcaaacagctaactttttttttttttgagatggagtttcattctgtcatctaggctggagtgcagtgacgtgatctctcagctcactgcaacctctgcctcctgggttcaagcgattctcctgcttcagtctcctgagtggctgggattacaggtgcccgccaccacgcccagctaatttttaaaaaatatttttagtagagatgaggtttcaccatgttgaacaggctggtatcgaactcttgacctcaggtgatctgcctccttcagcctcctaaagtgctgggattgcaggtgtgagccaccgagcctggacgaaacggctaacttttgaacctgaaaatttccactcatccagaagcattatcaattatgtaatatttataacttgctgcatgatgaaactgcataaaataaaccaaagtaagtttagttccatgaatctttagtatctaaggcaattttcgtattttctcaaaggcagtaggcaatgaatttaacaaattatgcttcttgccccaacaagaatctcagaaaaagaaattaaatcaagtattctatttttgccttaaaataaatatattttataatacatataaatcataatacaaactataatcttatagagctgtgctgttcaatatggtagccactaatgaccaatttttaattaatttaaattaactaaaaggcaataaaataaaacattcagtcccttagtcatattagtaactttttagtaatcaataaccatagtagctatcaggtgctgtattacacatctgtaaatataaaacatttctatcactgcataaagttctattggatagcaatagagaacaggcctgaaaatgaccactgaagctgatattccccttccgggtgggtgtgaaaactttatataatcactttcatcactcctgtatagctcatgtatacattattcacatattatgctataaataaaaatggctggtatacttgtttgaccttcacaaccaaataagtgataaacaacatgcctttaagataaatctggccaggcacggtggctcacgcctgtaatcccagcactttcggaggccaaagggggcagatcacctgaggttgggagttcaagaccagcctgatcaacgtggagaaaccccatctctactaaaaatacaaaaaattagccggtcttggcgatgcatgcctgtaatcctagctatttgggaggctgaggcaggacaattgcttgaacctgggaggcagaggctgcagtgacccgaggtcacgccactgcactccagcctggtcaacaagagcaaaactccatcttaaacaaaacaaaacagataaatttgacaagttcacaaagcaggtcttttgctatagataattataatctatagctcagtactatgaatctaaaatcatgagcttataagcagaaaacactgtacctggactagacagctctacgtagcatcgtaggcactggagatgatactagttctgaagtcaaaaaaatgattcaaatataggttctgccactttgtctgagaaaccttaaattcattgaatctagtttcttcactagcaaaatggaaaatatagtatacgtctgaaaagatcgttagcaggattaaataatttaaaacatataaatcatttagcagtctctaggcaaagtaagattcagtaaacacccctagcctggaaaagactaattttaataataagtaaatttaaaagttttacaggtgcgggatagagttggactagttctaaagaatagcaaaggaaattggatgggaattcaaaatagaaggcaaatgcaatttaaagtagactaaaaacattaattaccttatttgttcaagtttcagatatacacattcatacatatatatgaataaactgctgtaccacaaataaaaactttaaggaccaggtaaaaacataaaggcactgatggacactttccacaacaaatctatcagcttaaaagccttttctacttcagttgattgtaagtactccaagctcctccttccctataaatgaaaccctaggggtcactttgaaagcttcttcccaggggctgcatccagtacagaaataatctttggctacaattccacgtaactaaaaagagtagacatatataagcacacacagtatttaaagccgtggcaaatgtagcctattctcaggcaactttctgtagcctcttctgaggcaactttcatattataataatttttccttaactctgtcctttctgtaattttcttcctttctttcccttccttcctttcttttccttccttccttccttcctccctccctctctctctctttttctttttctttttttttttcagtctccctcttttgcccaggctggagtgtagtggcactatctcggctcactgcaacctctgcctcccaggttcaagagattctcctgcctcagcatccctaccagctgggattacaggtgcccaccatcacacctggctagtttttgtatttttagtagagacagggtttcgccatgttggccaggctggtcttaaactcctgacctcaggtgatccacctgcctcagcttcccaaagggctgggattacaggcatgagccaccatgtccagccctaattattttttattctattattgtcttttctctagctcattcactaataactcttccctcctcagaggaaactaattgaaatgtcatgtgaaccaaagtatttaaggttaatttcatgtaagtctgagatttgcttttaaaaaaatatccaagctggatgcaatggcatgagcctgaagtcccagctacttaggaggctgaagtgggaggacagcttgaagccaggagttcaagattagcctggggaacacagtgagactctgactctaaaaaaaattgttttaagttgctaaaaattacatataaatatatctccagtgggaggcacaggggttgggggtgtgtatacttgagttggtaactgttgaagcttgtgataggcacataaagattcattatattaatcctcttctgttttatatatataaaacatttaaaacaatgttttggaaggatggcatcagtaactagaaattttcattggtcacttacaatattcctatctttccataagataggaatatgttgttttttttttttgagacggagttttactcttgatgcccaggctggagtgcagtggtgtgatttcggctctctgcaacctccgcctcccaggttcaagcaattctcctgcctcagcctcctgaatagctgggattccaggcacctgccaccacgcccggctaattttttgtttatcgtagagtcggggtttcgccatgttgggcaggctgatctcgaactcctgacctcaggtcatctgcccgcctcagcctcccaaagtgctaggattacaggcatgaaccaccacacccagtcacctttaggtcttacttaacaactgcctgttacccctatctttccttctatttttccacaaaagtataccagaaagtttttcttcattgacagaagtgtaccttagaactagtcacaaaaattgacttattagcttgggagttattaacttgggaaccaagtttaattcagacaatcaagtacattgaccctgaagggaagagttccaaatcccttcatctataaaaccatgagcttctacatcttaaagtctgtatcgtctgtggaagacacaaatatgtactactctcctaatttcagggagtgaaaagaacaacaacaaaaacagaaaaacaggttgaatagtaaaatctcaaggatcaaggatgtgctatggtcaatttcaacagacaggtaaggtcaatcttaaaacaaaattgagttatcatccatgaaaagaaagtgtttctcagaggaacataggcttttatttatttttaaatataaatgcttttccccttcaaaggggaaaagtataggagctgaggtaacacacagaactaaacaagttcctacctccttttgttcttctttcttcctaacagccccagagccctcaatgttttcagagctggctaatactggtagtggtggcaggtgaagcaatgtggaggcacagggatccatgtcacactgttcgccttagggtggaagttgcaaactcacagtctggtttacagaaggatctgctttggcctcagagtgcttgggaaattcacattaggtgctaacatttcaaaatcagaataattcacaaaaaacctttaaaaagtgagaaatttggcaatgttggatgggtactctggcctggcaataattggctaaagctgagaagcagctgtccccctgagatatgaggctagtcctgctttgcaatcaagctgccacatcggtatctgttacctgcctggtgcctgcaagttgatttcaagagaaactgacaggtagttcttaagatctacaataggaaaggcaactaagccatgtacgtattccacagcttggacatgccaatcatctgactgctggggtataaggatctgtctttcatttaatattttaatagctaacaagagttgctgaatgggactttgtttagatgtgttgggacactacctctgtttcaaaagagaattacacaaaccactcgaatgccatatagttagaagctttgttagtctgggcaggcaggatgaactaaaaaatagcctcagcctggagggcatgctatcaccaagagaaactaaaaatggggcggtagaaggcatttcagtctataggagagcaaatggagaacaaaatcgaagaagttgagaaatgaaatggtatactcagttcctcatgtgtgggaggtattttgtaaacaattcctgcatgtattgataaacctcttcattccatcaatgaagataatgaatccaaagcggacttatcaaagaacaccaaggtaaaatatcaaagattcagaaacctttagttctggtcctgttttaaagttcatgtaaacatttcccccttaactcatggttacctaattttgtcattatcttacccattggttcctatgacaacttatcaaagaacaccaaggtaaaatatcaaagattcagaaacctttagttctggtcctgttttaaagttcatgtaaacatttcccccttaactgatggttacctaattttgtcattatcttacccattggttcctatgataacgaaatgaaatctatatccaaaagtacaagtctaagttattaatcatttattttcaacttcacatattcagttcatgttctgaaaattgattcaatccacaaaaagaaaacacaggaattcaaaaaaaatatgaaatgtcaaagacttcatgactaaaacaccaaaagcaatggcaacagaagccaaaattgacaaatgggatctaattaaactaaagagcttctgcacagcgaaagaaactatcagcagagtgaacaggcaacctacagaatgggagaaaattttcgcaatctatccatctaacaaagggccaatatccagaatctacgaagaacttaaacaaatttacaagaaaaaaacaaacaacctcatcaaaaagtgggcaaagaatacgaacagacacttgccaaaagaagacatttatgcgaccaacaaacacatgaaaaaaagctcatcatatttattgaaacaaaataacaaaataaatttgatggtttcacctaacagacattttgcagaccaagtagctgatcatttaaattaggtatttgaagagaaatatcaactaaatgctaaggactcactaaaataatacagaatctgaaaaacacaatatatgaagaatggatgggccaggcgtggtggctcacgcctataatcccagcactttgggaggctgaggcaggcagatcacctgaggtcaggagtttgagaccagcctggccaacatggtgaaacattatctctactaaaaatacaaaaattagctgggcgtggtggtgcatgcctgtagtcccagctactcaggaggctgaggcaggagaatagcttgaacccgggagtcggaggttgcagtgagctgagatcatgccactgcactccagcctgggcgacagagtaagactccgtcacaaaaaaaaaaaaaaaaaaaaaaaaaaaatagaagaagaagaatagatgaataaactattataagagaaaaaatgtttggagaggcgaggatcatgtttaaaggaagcatggtgtggtggaaagacagtaaactgcaagttaaaaacctgtggtttgagttctgaacttgccactaaaagctgtttggaatcttggattaatcactcaactttgatgggtctcagttctcttttttattaaatgatccataatagtatataaggatccttcagctttagaattctatgatttgtgttgattttttttttttttgagacagggtttcactctagttgctcaggctagagtgcgatggcacaatctcagctcactacaacctccacctcccaggctcaaccagttctcctgcctcagactcctgagtagctgggaatacaggcacacaccactgcactcagctaatttttgtattttttgtagagatgggtttcaccatgttgcccaggctgcaagtgatccacctccaatggcctcccatagtgctgggattacaggcgtgagctaccgcgcctggctttatgatttgtgatctgaaaagttattgcatataaaagcacttagaaaaaaggttagattctttaagtgtgatgctattctattattttacatggtaggttttcattacctttaaggtagatgagctgtaggaactatgtctctcttggtccaattcctcttccgatggcttaatgtgtatttctctccacatctcctagacccaggcttgagtggctttcattctctgctcccatttaaacaaatgagcagagcattatctcactttttcctttgtaccagggagtcacaactttctctcttaagactcccaaataccaacccctccttgtccatatctacagttaagactcccagatgaatgccaagagcacttctaatccatataaggttgttgtttcaggtatatccgggatacttaaaggacaatgtgcacaagcaaagcagcccaataggccaatacatgagataaattaaccacctttaatttcccaatacaaaccttaactcttcatctgtactatgcccatctctgccctcccagggggtgttccttctggcaaactctaaattggtgttctgggtcctaatccctcttacattctcagaaacctttactattgaggatccccccttctttcatctgtactttctaattgtctctctttgctggataatttttatcagcatttatacatgctaagcattgcccatcttaaaaacaaacaaaaatgcctccttggtccttactttgcctctctagcttccagccattctgtcccacctcttcacggcctagcttccagccttactttgtgtctctctctcattaacagcactccagaccctctgagcttttttcaagttctttaagcactggcttggaatcaaaatgtaagctgccttgtccatttatactggtaagcttaggcaaattactttacctctgtgctttagttttatggcttgtgaagtggagataccagctcaatatacatgtgttgaataaatgagtcttctgcagaatttatattttagaaaacacatagttaccttttctttataaagttggtagataatccaggcatcttattcttctatttcccttttattacctgctactcactttatcatttattagtgacaccttaatgcttatcaatgatcacagatggaaagaagcttggatcagtacaagtactacttgataaatgctctaattaccgcaaaattttacttaaaaagcaagaagaaacatgcttaaaaacatcttctggaatatatgtggattactcttctgtataatgtttccctaatcattatgttccttttacctgaaatgacctcataaaaattctcttcccatatcccaccctatctagttagtaaatgcatatttgtcctttaaaacccagtttagacattagtcccctgagaagcattccaagatgaactttcctttcatgccatcttcaaccagtatactctatgtattttcaacacacttccactgtgacatctacacaatgtaacaaaatttatgtatgctctgcagctaggcaatgcatttcttaaagacaagacaacgtcttattcatttctgtatctaagggcctctctctgtggccaatatatagccactcagtggacatttatttgaactgccaccagaaagcaaaaacagtatttagaccctaagttgtagaacactggtttaagaaacaaagtccaatcttacaaaaatgttaatgcaacaagaaagtattatgagaaatgagtttttgcccatagaacttattttatcattaagctagaaagacaaagtaaaaaattctcacagatctgacagacatatttgcaaacaatgattcagtggagagaactaaggatcagtggtcataagtagcctgaattctatttctatctttgatattatccaacactgagaaaattatcaagaattatctccttcaacctactatttgcatacagtaggagtgacaactacaatggaaccatacacgttaaagtattaaattataaaaaataaagatgtcacataaatccaaggaatgatcactatagttacagttatgactgattacaattcaaaactaaacttctgaagatacaattcaaaactaaacttctgaagaccctgctgatcaaattaagtttccactgactaagaaaaggttcagaaagatttacaaatcaatatttttctaagtgttcaacacatcttaattaaaatttaatctgatacacacaccaacatgcatgcagacacacacacacacacacacacacatatatgtgataaacatatacatcctagaaatttggatttacttaaaattctttcatgagtcctctttactaaaacaaataaacagtttgtaaaaataacattaattatttgatcacagctttagttacatgatcaagtatggaaattctaatacaaataactatcacaaggagggttattttaatcattatcagttaagaacataattaataaatttaaattcattttttaaatctggaaaatataaccatactaatgtataatagaattaattcagtttgaatagcatcccattttgagaaccgggacaaacttccttgaaagtttgttagatttctttttgtactggaggtggacaaacaaacgccaacaaaaaattctccatacaaacaaaatctaacttgggatattcaaccaaacaatattttggataatataataaatacagttaaggatatttgggccgggcacggtggctcacgcctggattcccagcactttgggaggctgaggcaggtggatcatgaggtcaggagatcgagaccatcctggataacacggtgaaaccccatctctactaaaaaatacaaaaaattagcgggcgtggtggcgggcgcctgtagtcccagctactcgggaggctgaggcaggggaatggcgtgaacccgggaggtggagcttgcagtgagctgagatcacaccactgcactccagcctgggtgacagagcgagactcttacctcaaaaaaaaaaaaaaagaaagaaatattctaggttgggcacggtgattcacgcctgtaatcccagcactttgggagactgaggcaggcagatcacctgaggtcaggagtttaagaccagcctcacaaacatggcgaaaccccatctctactaaaaatacaaaaattagccaggcgtggtggtgggcacctataatcccaactactcagaaggctgtggcaggagaatcggttgaacccaggagacgaagctgcagtgagccgagattgagccactgcactccaacctgggtgacagagtgagactctgtctcaaaaaaaaaaaaattctaaaatactctaaaagtaggtatgttttattattttgatcttaactaattaaaaaactgaagcaggccaggagcggtggctcacgcctgtaatcccagtactttgggaggccgaggcaggtggatcacctgaagtcaggagtttgagattagcctgaccaatatagtgaaatcccatctctactaaaaaatacaaaaattagctgggagtggtggcaggcgcctgtaatcccagatactcgggaggctgaggcaggaggattgcttgaattcgggaggcggaggttgaagtgatccaagatcacgccactgcactccagtctgggtgacagattgagactccatctcaaaacaaatcaaaacagaacaaaaactgaagcacggagaagttaattacttcaaatacggagtcaagctttttcatcctacagaaaataatttttttaatgatcacgaaatttctttctttttttttttttttgagatggagtctcactctgtcgcccaggctggagtgcagtggcgcaatctcgactcactgcaagctctgcctcctgggttcacagcattctcctacctcagcctcctgagtagctgggactacaggcgcccgccaccacgcccagctaattttttatatttttaatagagacggggtttcaccgtgttagccagcatggtctcaatctcttgaccttgtgatccgcccaccttggtctcccaaagtgctgggattacagggttgagccactgcacccggcctcacttttttttttttttcaaccagaaagatatccaccaaggcaatgaaagaaattacagaaatttctttaatgaatatagagttccattaagcagcctgctagaacatagtgtaaagagaaagtgtacatattggctttttctagtgtgggtgtcctggtattcttgggatctttcacctactcatatgagtcagttttatataacactgtaacacataatttccctcctacacacaagccaacacttcagcaataagatcttaccataagttatttaaggaatatggtaacttgcaacattttagtattttataaaatgtgcaaacaaccaaattattactatgtcagcaacaagctccttggcttccaaagaagcattcactgtgtttcagagttttggggagatgttaagaaaatatataaattgcttcactgtaacaaaatatcgtaactatttttaaaaacttcatattttatcaaatattagtcattttgtatgtaaagaaaggtaattaggcagtgattttgcaactatatatttactggggaattatttccatggctactaaagataagtaacagggttcacgaaatgcagaattgattcagttttctcgatagtacatcaaacattccatttctgaagggtaatggaaagggtatacctaaaatcaagttaccacaaatacaaagggaatatctagatcttttttatggtataggctaaagttattttgcctttagcattaccaaaaatcagtcattacatgactagtctttggaaattattatattctgacattttccattgaattatttatcatgaagagacaacttcagtcttctttcactggaaggatgaaggctcccaaaggaagaaagcaaaatagaaaggaaggaatgcaaagtgaaacagcaaataaatgtaagaatgaaattcttccctgagagacttgagaggctcatggcattataaagaaaagcaccaactttatatctgatgggaaactaatttaaaacaaaacatactgtcatagataacctcatagtatatgaataatttctatcttatagtgtattcaaattagatatgacctgtttaaaactcacagatgtggccgggcacggtggctcatgcctataatcccagcactttgggaggccgaggcaggcagatcacaaggtcaggagatcgagaccatcctggctaacacggtgaaaccctgtctctactaaaaatacaaaaatatagctgggcatggcggcatgtgcctgtagtcccagctgctggggaggctgaggcaggagaatggcgtgaacccgggaggcggagcttgcagtgagctgagatcgagctactgcactccagcctgggtgacagcgagactcggtctcaaaaaaaaaaaaaaaaaaaaaaactcacagatgttcacaagcttgggattattttgggatgcttgcattgtcactatttgacttttttcccccagtcttgcattatgacatgtcagaatctatggtataacagaatgccattgtccatatttcatcataacaagaatctgcaatattctcatggaaggcagagtggtggaacagaaagagtaaagcaaaaataggttgaaatatcagccacctctgttattggcttataagtcttatacctcagacaaattacattgagagttgaacaaacaggaggctgttaataaatttgtataaatgaaccactttaagctcaatgtggttcatttacaggtaaaggagagctagtagtaagtttatacatcgtagggttgtagccttatatatgtaacacttctagcatataatatgtgcttttgaaaatcaaattcactttcatattcattcctataccctaagaaagtggaccattcaatattactagtacagctgtactataagcattttaaatatacagtcaaatggcattaagtacattcactttgttgtgcaaccttcacaactatccatctcctgaactttatcatcccaaactaaaactctacccattaaatgataattctcatgatgtcccttctccataaactctggtagccaccttccattttctgtttctatgaacttgaatattctaggtacctcatgtaaatgaaatcatataatatttgtccttcagttatatctaaaggatcaaataatccaatggtaacagcaactcatctaccaaaaagacctaaaataaacatatgcaaacataccaacaccacaaaaatctatttttatgatcaaagaatttgagctgggaaaaggacattgatatactaaccaattttatggcataactggaaaactactaccattgcccacataatgctttataagtactaagtagcagtatacatatgaaaggactcaggtaatgtacattgcctttgtctcaagatagctagtaatatgctaaaaaaaaaaaaagatggaaaggaaaagaatatggaaatacacattcgattttaaaatgtgttttcataatagtgtatcattccacatcattaagtaagcccacagaattattctggtgcctatgaatagataatggtgtcttcgtatttgtcttaaatagaaccaaggtcattgtcaaagatttctggctatgacacaatggccatctttcttttagacccccaggtggcagtgtggcccagggcagaagtcactttctcagctgcaaagcttccatcctacccaatataaaaatatcactttttatagaagaaacttaccttgcctgatagacacacttataaaaactaatgtaggacacacacagaggctcatgcttgtaattccagcactttgggaggctgaagcaggcagatcaattgatctcaggagtttgagaccagcctgtgcaacacagtgaaaccctgtctctaccaaaaacaaaaatacgaaaaatagcagggtgtggtggcttgcgtctctagtctcagctacttgggaggctgaggcgggaggatcacatgagcctggaaaccagaggttgcagtgaaccatgatagcacccctgcactctggcctgggagacagatcaggaccccatctcaaaaacaaacaaactgacaaaaaaccaaaagactaatctagaatgctaaaaccaacaattagttccagttcatttttagtaaataatataaattcattggattctgccatgtttgactcaacccgactctagccttacttaaatttcctctttcaagggattgatataatttggatgtttgtcccctcgaaatttcttattaaaatgtgatccccaatggtggaggtagggtatcgtgggaggaatctggctcatgggggtgtggtgccctccccacagttagaagtgagttctcacacgtttagttaccatgaaatctgatcattcaaaagaagctggcgcctcctctctctcttgctccctctctcaccatatgacatgcctgctcctaaccttccaccatgagtaaaagctttgtgaggtctcaccagtagccaagtagatgctggtatcatgctagtacagcctgcagaaccagagccaaataaacttattttctttataaattacccagcatcagatattcatttatagcaatactacaaggactaatgcaaggatggataatgaaatattttcgagaatacctatagttcggtttaaatatagtacagttactatgataagctgaaagttcaatatctaggtgttcaaagttatttcttctaaggtaggggaaagaaaggttttatacataccagtgaggtatcataaaccgagaattgagatgcaactcaaaagggcattaccttaatccaaaaacacaccacccttgcactcccattcacacactgactttcaggatgatactagccatctgcctctgccttcatgaactggtaagaaccatggcatgcttgttctgcagacaaaagggctgttctaccttgcacttcatttgttggtttcctcatttgttgatgcctaacaatgggatcaaccattcacttacccagtagccagttttattgttagaaatgtaacacattcttctgtattttgtaactattccccaatttctagtttctgaatagaaaaaaccctttcttacacagtctgtacttacacatgaagcattcacttaacattggggtcccatttatgtcttcactgctagagaggaacctcttcctgccctccatccacttctctgtctgcagtcattttgaaagcctcagtttgcagagatgattcatctattcataaatatgtaaataactaactcacaataattaaatctaaagcttcttgactatatcttttgaactgggcatcatgttgtcatgctcaatttcatagagttttaagagtatacccatgatcataatggtggcatgggcatactcttgacatggatggaatgaacagaacctaaagccagctttggctaaagctcatgcttcttttgtgctatcccagtgttattaagtacttaaaacaatgctaagcactacacagatactttccagaaaggccaagttttaaagttatttcattaggttattttggggattcacaaaaacatacacagtgccaaaggatatttaaattaaccaaagaaaaaattaaagtggctaataaggcaaataaaaatattaaaattttggctgggtgcagtggctcacacctgtaatcccagcactttgggaggctgaggtgggaggatcacctgaggtcacaagttcaagaccatcctggccaacatggtaaaacccagtctctactaaaaataccaaaattagccaggcatggtgacaggtgcctgtaatcccacttactcgggaggctgaggcaagagaatcgtttgaacccgggaggcggaggttgcagtgagccaagattgcaccactgtactccagcctggacaacagaacaagactccatctcaaaagaaaaaaaagaaaaaaaattaaaatgtttagtgagcttgctgatctaataaaagttaaagagtcaactaaactcaatgtatggagcttatatggatcttcatatgaataaacaaacggcatgaaaacacttttgaaataagtggggacattttaatatgtaccaaatattagatatattcagcaattaaattttgatagctgtgataaataacattgtatgtatgagaaagtttcttatttgttagagattaaaatgacagaagtatttatgggtaaaatataatttcttaaatttacttttaaacattccagggaaagaaaagtatgtctgtagataagggacaggaaacagaacaatcaataactagcaaaatgttcataattattaaagttgggtgataaccacacaaggggttcttatactcttctctgtacttctatatacacttgaaaattcctataataaaaatgtttagataaaacaaaaggcagtactgtactttgtacattttcttaatggtactaaacactaggtaattaagttacaaacctcagttgagagaaaaccagaaaatccaacaaatattgagctctccatatttcttttcctttttttttttttttttcttttctttttttcacactgggtctcactctgtctcccaggctggagggcagtggcatgatcatggctcactacagccttgacctcccaggctcatgagatccttccacatcaacctctcaagtaggttgggattataggcatgtgccaccatgcctggctaatttttaatttttatttaaaagaaattttttatagacacaggacctcactatgttgcccagactggtctcaaattcctgggctcaagctatcctccaaccttggcctcccaaagtgctgggattacagacataagcgaccatgcctaccttctctatatttctaataacatattttactgttttaaactcttatcatatttgcttatacatcatcactttttaattagtgattttaaatttagtgtttaattttcattttacttgctgttgaagtatagtatgtctttttctctgttatgtgtaaatatacatacacataaccagaaagagggagaaagaaggatggatatgcatatgtaatatgaaaattacccaaaatagaacttcaaaggcaagcgatgattagaggggaaaacagtcatagtctatactaattctctggagttttccaaagtcttagttatgctgattattctccatttgctctctcctacagaatactcccttgacaaccagcttctaatggagtttgatcaatggaggttatacaacaggaagaaggaatggtagaggaaggtctggtagtagctggatcctgcctgcggcccctcttccttacctccaaggcccactgggctatacttgttctctcaggcctaggaatggtcatgactggctgctatctattgccggtttttggtaactgaaactaactgttggctctcttaaccttagacctctgaaacagctttccactaagatcttttaagttgaatcatctgagtaaatttctattttttgcttgaactgactaatgaagtagcataagaaaatacagtaggccaggtgtggtggctcaggtaagtaatctcagccctttgggaggccaaggctggaggactgcttaagcccaggagttggagaccagcctgggcaacacagtgagactccatgcctacaaaaaattattagccaggtatgatggtatatgcctgtggttacaactcaggaggctgaggtggaaggaggactgtttgagccctagaggtgaaggttgcattgagccatgatcatgccaccacactccaatctgagtgacagaatgagaccctgtctcaaaaaacaaaaaaagaaaagaaaaaagagtgttaacagttcagtctggaaacacacacacatatacaaacacaaaacaaacacacccaattttttattgcttattagaatttttctttttgataaattacctaaaatagaactatttcgatagtgtctatgcttaaaaatatatatatacatacacacgtctataaatatacatatatacattgtatgtatatataatgaaaagcaaagtacatgtaatagttttggtaaacttgttactgaagtattaaaaacacagaaattatgtaaatctcaagtatatggcttaagaaaattcaaaaattttcataaaaagagcataccaatgtaaatagcaccaagttaaagaaacagaatattatcagcacccccccgaagcctctcttgtggcccatcctttcacaacaccgccacctccactgaatgctatgctggccactgactgacactgaacaccatagattaatatgttatttatatttcacgtaagtggttatacataaattagtatcttatataactcttatgtaaatggacatatacacttaatgtatgtatgtacaattaatatatgtcttttatggctggtttctttcactcaacactatgtttgaaaaattcatccggttgttatggtagtgataaatttgttcattctcattgttttaagttttccactatgtgaatataccatgattatctcccattacagagtggatagacagctgaagttaactattatgaataaggctgctattcctaactattatgaataggactgctattcttttgttttatatatataaacatatatgtgttatatatgtttatatgtacttaatacatgtttatgtatacctgttatatgtatatatgtatattttatgttctatatgtatatatgtaaacatatgtgtatacatacttatatatgttatatatactgatatacctacaggaaggattactagctctcagaacacacatacgtagacactgccaaacagttttccaaagtagttgtgccaatttccccttctaacaatagtataagacagttaacactgtttcacatccttgctggtattgtcttttttttttttaatgcagtcattctggtggatatgtatgtagtggcattccaattttgttcttatatatgcatatctccaacagaaattaatacatatgttcaccaacgcaacttaattttattccgaaattcacaggctagagaatcgtagaagggtactttcagataaaaagtctgataaagtaggtttatctacaatgaaaacagcagttaagttcacctatttaaaaagtacacctattggccaggcacggtggctcatgcctgtaatcccagcactctgggaggctgaggcaggcagattacctgatgtcaggagttcaagaccagcctggccaacatggtgaaacccccatctctacaaaaatacaaaaattagccagacatgatggcgggtgcctgtaaccccagctactcggaaggctgaggcgggagaatcaagctacttggaaggctgaggcgagagaatcgcttgaatccaggaggcggaggttgcagtgagccgagattgtgccactgcactccagcctgggtgacagagcgagactatctcaaaaaaaaacaaaaaaggacacctattgatacacgcatacataacactttcagacacggagagccaagtctctctatagacactcttatgggacccaccctgcttgaagaggggacacaactatgatgctattctacaaatcaaattaatactattcagaatgccaagatacggtttctcataaattagatgaatcaggcagtatgcaattaattagcaaatttttgtaacttatctcttttggttttttatacctatacttacgattaattcatattttctttttttttttgagacggatgctctgtcacccaggctggagtgcagtggtgccatctcagctcactgcaagctccgcctcctgggttcacgccattctcctggctcagcctccaaggtagctgggactacaggcgcccgccaccatgtcaggctaatttttttttttttttgtatttttagtagagatggggtttcactgtgttagccaggaaggtctcgatctcctgaccctgtgacctgcccgcctcagcctcccaaagtgctgggattacaggcgtgagccacagcgcttggcctcatactttcacttaattacccttaccctgttaggctgagatgataagcatggaaattcatgcccttgaaataatttaacaaagaatcttcttatagtaaaaccaccaggtattttttgaagaaaatgtttgttcactgatgcaaaaattcaatctagtcagccaaataataaggattataagacaacaaaaacagcacacctaaatgggtaatgtaacagaaaacttttcaattttaggagagaaaacaaaacaatgaaagaaattaggttgtcatcaagtgatacttttaaagaataaaaattactatgaaatcttctcttatcctttttgcaaaagccttaaatactacaaaggttttttttaatcttttattattattattattatactttaagttttagggtacatgtgcacattgtgcaggttagttacatatgtatacatgtgccatgctgttgtgctgcacccactaactcgtcatctagcattaggtatatctcccagtgctatccctcccccctccccccacccgacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttaggttggttccaagtctttgttattgtgaataatgccgcaataaacatacgtgagcatgtgtctttatagcagcatgatttatagtcctttgggtatatacccagtaatgggatggctgggtcaaatggtatttccagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctacataaatgtcttcttttgagaagtgtctgttcatatcctttgcccactttttgatggggctgtttgtttttttcttgtaaatttgtttgagttcattgtagattctgtatattagccctttgtcacatgagtaagttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtataacgtttaagtctttaatccatcttgaactgatttttgtataaggtgtaaggaagggatccagtttcagctttctacatatggctagctagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccaggaccatgctgttttggttactgtagccttgtagtatagtttgaagtcaggtcgtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggcgattttcacgatattgattcttcctacccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttgatggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaatgccctttatttccttctcctgcctcattgccctggccagaacttccaacactatgttgaataggaatggtgagagagggcatccctgtcttgtgccagttttcaaagggaatgcttccagtttttgcccattcagtatgatactggcagtgggtttgtcatagatagctcttattattttgaaatacgttccatcagtacctaatttattgagagttttcagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccaatattttattgaggatttttgcatcaatgttcatcaaggatattggtctaaaattctcttttttggctgtgtctctgcccagctttggtatcagaatgatgctggcctcataaaatgagttagggaggattccctctttttctattgattggaatagtttcagaaggaatggtaccagctcctccttgtacctctggtagaattcggctgtgaatacatctggtcctggactctttttggttggtaagctattgattattgccacaatttcagatcctgttattagtctattcagagattcaacttcttcctggtctagtcttgggagagtgtatttgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctctttttttattagtattgctagtggtctatcaattttgttgatcctttcaaaaaaccagctcctggattcattaattttttgaagggtttttgtgtctctatttccttcagttctgctctgattttaatatttcttgccttctgctagcttttgaatgtgtttgctcttgcttttctagttcttttaattgtgatgttagggtgtcaattttggatctttcccgctttctcttgtgggcatttagtgctataaatttccctctacacactgctttgaatgcgtcccagagattctggtgtgttgtgtctttgttgtcgttggtttcaaagaatatctttatttctgccttcattttgttatgtacccagtagtcattcaggagcaggttgttcagtttccatgtagttgagcggttttgagtgagattcttaatcctgagttctagtttgattgcactgtggtctgagagagagtttgttataatttctgttcttttacatttgctgagaagagctttacttccaagtatgtggtcaattttggaataggtgtggtgtggtgctgaaaaaaatgtatattttgttgatttggggtggagagctctgtagatgtctattaggtccgcttcgtgcagagctgtgttcaattcctgggtatccttgttgactttctacaaagtcttttcttccccagacagacaattaaaacaaattactctgccaggatttccagaaaaaataaaattcactttatgtcagaacaatagccatacaaagagtatgaactaatgaaaaaggtaaaaaagaaaatgtacaatgctaagcctaataatttcattcaatcacaagcttcttacatctcctgaatgaataagtacatgacaaatagcaaatgttcttgttcaactgtatactataaatttcatgtattattacattgtcaattatttttaaccatgtatattcacaatatacatatccagaaataaatacatgacataaatatgaattaataaaaaattaggcaatgtatctaacactaagcttgatggagcagagattcaaagatttaatgcatggttttttaatatctatgaaaaaattgggagaaatctaaaaatctcaaatggcaaaacaaaaagataggttaccaaaagtattaaatatttcaaaaacctgtcttggtttttaaatatttaataaatattaataaaataaaattaattaaaatatttaataaatattttaaatattacagtggctcacacctgtaatcccagcactttgggaggccaaagtgggcagatcacttgaggtcaggagttggagatcagcctggtcaatacagtgaaaccccgcctctactaaaaatacaaaaaaattagccaggtgagatggtgggcacctgtagtcccagctactcgggaggtagaggtgggaggatcacttgaacctgggaggcagaggttgcagtgagccaagaatgcgccactgcactccagcctgggcaacagagtgagactgtctcaaagaaatatgaataaataaaaataaatatatttttaaaaccccaataactgagggagtatacctagaaagaacacttcaggctatacatctcagagaaacaaaacaaaacaaacaaaacaaaacaaaacaaaacaaaacaaaacaaaacaaaacataacataacataacataacataacagccaaacacagttccaaagtaggaggaatagctgtgttgcaaagtcaagaatcccttctttacagcaacacacgatgatatgtacactgtctatcccaggggccagtctgggtgcaggagaagagaagcaggcaaggctcaacgacaaatgctgaatgtaggaagtagtcatattaaggcaggggcatgtatgagagactttgccctgctagccatctttcttttgattcagaagatacaggcatacctccaagattttgtgagttcagcccagaatgagatagattattacaataattattatagcagtcaccatttacagtgtctgctcccctagaggcactgtgcagggtgctgtcataaacatggcatttaatctttatagttggtcacaatactgtcagaatgatacaggcataccttggagatattgcgggttccgttccagatcacgtcaacaaagctaatgtcgtaaaaaggtgagtcacacagacttgtttcacagtgtatattaaagctctgtttacaccataatgtagcctattaagtatgcaatagcattatgtctaaaacaatgtacatatcctagttgtaaaacattgctaaaaaagggtaatgaacatgtgatcgtttagagagttgtaatctttttggattacattttcttcttatatctcctcagacatgaataagtaaatgacaaataggaaacattcttgttcaacagtatactaaaaatttcatgtattaatacatatatcaattattattaaccatgtatattcacaaatacacatatccagacataaatatggagagtgaagggttttacctcgacgattgttgatggctgctgactaatcaaggtggtggttgctgaagggtgtgacggctgtggcaatttcttgaaaataaggcaacaatgacttatgccacatcaattgactctttctttcatgaaagatttcttgaagcatacactgctgtttgaaagcattttagtaacagtagaagttctttcaaaattgaaatcaatactctccaacctgctgatgctgtatcaactcagtatacgttttattcttaattttttgttgtcacttcaacattgctcacagcatcttcaccaagaatagattccatctcaagaaactgctttctttgctcatccataagaagcaactcctcatcgttcaagttttaatgcaagattgcaacaattcagtcacatcttcaggctctacttctaattctcttgctatttccaccacatctgcagttactttctccactgaagtcttttttttttttttcaatataagaggagtcttgctctgttgcataggttgaagtgcagtggtgtgatctcagctcactgcaacctccactcccaggttcaggcaattctcctgcctcagccttctgagtagctgggattacaggtggttgccagcatgcctggctaatttttgtattttcagtagagatgggattttgccatgttgactaggctggtctcaaactcctgacctcaggtgatccacccgcttggcctcccaaattgctgggattacaggcatgagccactgcacccggtcccctctactgaagtcttgaacccctgcaagtaatccatgaggactgggatcaacttcttccaaattcctattgatttgacattttaacctcctcccatgaatcatgaatgtccttaatggcatctagaataatcctttccagaaggtttaaaatttagtctgcccagttccatcagaggaatcattatctttggcaactacagccttacaaaatgtatttcttaaatattaagacctgaaagtcaaaattactcctggatacatgggctacagaatggatgctgtgttaccaggcacgaaaacaacattcatcttgtatatctacaatagagctcttgggtgaccaggtccattgtcaatgagcaataatattttgaaaggaatcttttttctcagcagtaggtctcaatggtaggcttaaaatattcagtaaaccttgctacaaagagatgtactgtcatccaggctttgttattctacttatagaacacaggcagagtagatttaggataaatctgaaaggctctaggatattcagatggtcaatgagcactggcttcaccttaaagtcaccagctgcactagcccctaacaagaaaacctatcttttgaagtttttaagccaggcattgacttctctctaattatgaaagttttagatggtattttcatccaatagaagcctgtttcatctacattcaaaatctgttgtttagtgtagtcacttttatcaatgatcttagctagatcttctgagtaacctgctgcagcttctacatcagcacctgctgcttcaccttgcacatttatgttatgacgatggcgtttttccttaatcctcatgaaccaacctctttagcttcaaatttttcttctgcaggtttctcacctctcagccttcataaaactgaaaagaattagggccttgctctggaattaggctttggtatacgggaatgttgtgactggtttgatactctatccacaccactgaaactttctccacatctgcaataagactgttttgctttcttatctctcatttgtatactggaggagtacatttaatttccctcaagaacttttcctttgcaatccacaacttgggctaactgtctggcacaggaggcctagcttttagcctatatccacttcgacctgccttcctcactaagcatgatcatttctagcttttgatttaaagtgagagatgtatgatctttccttctacttgaacacttacagcccactgtagggttattaactgacctaatttcaatattgttttgtcttagggaatacagaggcctgtggagagggaaagagaggaagagccagtcggtggagcagttagaacacacataatatttatccattaggttcaccatcttatatgaattggtatcattcatggtaccccaaaacaattataatagtaaactcaaagatcactaattactgatcaccataacggataatgaaatagtttgaaatattgagaattactaaaatatgacacagagacacaaacttaacacatactgttggaaaaatggttctaaaagacatgcttaatgcaggaataccacaaaccttcaacttgtaaaaaccacaatatatgcaaagcacaataaagcaaattataataaaacaaagtatgctatataatcaaatatagcatactatatttgattatactgtatagcatatatatttgattatactatatagcatactatatttgaatatactatatagcataatttgtaaaaaccacaatatatgcaaagcacaatttgtaaaaaccacaatttatgcaaagcacaatatatgcaaagcacaatttgtaaaaaccacatatatgcaaagcacaatatatacaaagcacaatttgtaaacaccacatatatgaaaggcacaatatatgcaaagcacaatttgtaaaaaccacaatatatgcaaagcacaataaagcaaattataataaaacaaactatgctatataatcaaatatagcataccatatttgattatactatatagcatatatgttttattatactatatagcatactatatctgattatactatatagcataataaaacaaagtatgctatataatcaaaagaaatcaattacatacaaaaatagtgtcatatcaaaagaaatcaattacacacaaaaacagtgtcataaggagaataggtgttagtctataacattgctctagcccatactgtttgcaagatgaccttttgcaaacagtatgatcaggaaaaaatgtttctcattgaatgatgagcagtcattcttaaaaaaggaatctacaaataaaatgaaggaaagaaaaaggaaaatcaaatggaaacacataagaaaaacagttatgaagcagatgaaaattatagtcaaatatgttctcactcataggtgggaactgaacaatgagaacacacggacacaggaaggggaacatcacactcgggactgttgtggggtggggggaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaataaaattaaaaaaagaaaattagtcaaatatgttgccacaaatataaacttaaagaagcaatcacctctataacacagaaaacataaagaggagatgcaggagctcaggggagctatggtcaaaaagatgaagaaataaaatgtgaacttacaggtcagagaaataaaaaaaatacataaataaacaaaactgaaatgaaggccaaatggaagcagaagagagaacaggtactactaaaataggaaagtacacacaggataggattgaaaaggaaattttcaaaaagaatttaaacaaaaaaaagggttttggagaaaaaaataaattaagaatgcaaaagagaaaaaaacaagtgatataaataggccaagacaaatcaacaaatataagcatatttgatgtcttcaaagaagcaagccaaaatgaaaaaagtaaaaaactgctctcagtgtaattcaagagaagtttccagaagtagaagaaaaatgtaaactagaaactaaaagaatatggcacgtccaagaaaaagagaaacacaaaggtcaatgccaagacatattctagtactggactgcaaaaaatgggtagtgaggtaaaaaattgatcacttctaagtagaaaaaaatccagtgagtcctcagactagtctgtagcaaacagtgagcactgcctacaaaatcagccaggaaataaagtgggcctgaggaatttcttaccccacagatgtgtaattataaagtgagtgaaaggatatttttagaatacgagagaaaatatttacaaaatgtctatctgatgagaaattaatagccagaatatataagaaaactctatagcaaaaaaagagaaatattccaattaaaaaatggacaaaagatctcaacagacaattctcaaggaagatatataaactgccaacaggtatattaaaaatgctccacatcactaatcatcagagaaatgcaaatcaaaaccacaatgagatatcatctcaccccagttaaaattgcttttatcaaaaaaaatgggaataagggatgttagtagagaaagaggaatccttgcacactgttggtaggaatgtaaatcagtacagctgccatggaaaccaatatggagattcctcaagaaactaaaaatagaaataccaatgatccagcaattccactactgggtatatatccaaaagaagagaaatcaagagatatctgcactcttatgtttactgtagcaatgtactcaatagccaaaatgtgtaatcaacttaaatgcccacgagtagataaatggaaaaagaaaatgtgatatatatatacacaatgaatattattcagccataaacaagaataaaatcctctcatctgcagcaacatggatggaactggaggtcatgatgttaagtgaaataagccaagcacagaaagacaaatatcacatgttcgcactcatatgtgggagctcaaaaagtgaatctcacaaaggtacagagtaccttagtggctactagtggttgggaagggtagtggggaggggaggatgaagaggttgattaatgggtacaaatatacagttagatagaagaaataatacctaacgtttggtagatcagtagggtgactacagttagcgttaatctattgtacatttcaaaataacttcaaccaaaggacaccgtacagaaacaaaagggaccgagggaagcaatgaaaatacttcactatttaaataatacttaactatttaaataatctggtttacagatgagaacataagttatagataatcacaacacagaaattacatacctaacagaaggtaaaagggaaacaaaggcaaagtttaaagttggtaaagaaataatgttaagtatttttttaaattaatttattttttttgagacagtcttgctctatcacccaggctggaatgcagcggcacaatcttggctcactgcaacctccacctcccgggtttatgcgattctcctgcctcagcctcccgagtagctgggattacagtaatgtgccactatgcctggctaattttttgtatttttttttttgagatatagtctcactctgttgcccaggctggagtgcagtggcgcaatctcagctcactgcaacctccacctccctggttcaagcaattcccctgcctcagtgtcccaggtagctgggattacaggtgcatgccaccaggcccagctaattttttttgtatttttggtagagatggggtttcactgtgttagccaggatggtcttgatctcctgaccttgtgatctgcccgcctcagcctcacaaagcgctgggattacaggtgtgagccaccacgcccagccacatgagtatttttataaatgaaaagtgtaagtattattaaagatacaaaggtgaacatcaaaaaaataaccaattgatatcgtgctcagaaaggacagagagggagaaaaaggcaatataccaatgtcactgcatataactgggaataagaaaacaatacgtaataaaatagagaacagagtatattacacaaaacattagttataaagataaccagtggattccaaaccaaacctttaaattactaatggtttatactaaacgaaaacaggaaaacatggattatataatgacatatttagtggatcatagaatgatcatataataacatatttttaggcaacagaaaccataacaaatactatgataattgcataaagactaaatataactctaatatcaatgaatgaaagtgagtttaacactgttacttaagagaaaagacaaactgagtaacaaagtgaaacctaaccttgtaacataaaaatttatctaaaggtttcaaaaacgttgaaaataaaaagatggttaaaggcatgctaggaaagcatggacagaatgaaatagttgttgggatactaattacagatcacattcagaggacgaaaggaaagaactaagtgattttataataaagaaattttataatgataaagagtataatccagaatgaatgaagacttaactgtaaggtgtctgctcccagtactatggtgttttagatattctaaaaatccctccttttgcaaacacctagaaatgctaaattaggtaaaacattatcttttaaaatgtagcaccagtctgaagaaaaagtaaaggtaatttacaatgttcaatgaaaatttacaaagagaaagtcaaacatacagtgatgagtgataaaaacacatgctacactgaaggtgtctacagaagccaccaacaaagaaccttaggactgaagaaccatgcagagcaacaagaataaggccctagacctaaaagaaatagatagtggaaataagagtcctaaataaagcttcagcctaagaaagctggagattaaatgaaaatggaagaagggtgacaatagaaaaagggatccagtggcaaaaggaaacaaacaggaaatagatttagacatatgtggtcaatcaatttttcactaaagtgccaaggtaatttatgggaatgatagatttttctacaaatggtgctgaaataactagatattggtatgaaggaaaacagaacctagaactcctacctcaccccgtatttaaaaattgagatgataccaaatatatatatatatatatatatatatatatatatatatatatatatatatatatatatatatatatatatatataaatagaaaaaggaaaactataaagcttcccgaagaaaacagaagacgattttgtaatcttcaggtaggaaatgacttgttcaaatataaaaagcactaactataaaaggaaaacttgatgaagttaattttattaaagttaaaattttctgttcattagaatactatactacaaggaaaatcaaaaggaggctacagactagggaaaatattcacaagatacatatctggcaaaagtcttatatctagaatataaaaagaacttccaataaataataaaaaggcaacccaattaaaacaagggcaaaacatttcagtactttacaatgtatctattatatgttgtatataacatatataactatataaggatgatctgtaagttcagggaaacatgttcaatattattcagaaagtacaaagtaaaacataataagctacatctcgaatagtcattcattttgaatgcctaaaataaaaaaggctaacaacatcaaatgttgacagagatgtggatcatctagaactctcatatattgttgacagatgggaaaaagttggacagtttttaaataaagttaaagcacactccacccaaagagctaacaagagaactgaaaacatgtccatagatggactcatctaagaatgttaagactatctttattcataagagctctaaaccagagccaacccaaatgtccatcaccaagtaaatgaacaaaataattgtgacatattcagaggtaaaacaacatagatgaaattgctaaaacattatattgagtgagagaagatccacataaactgcatgattctgtttgtagcatgttccaaaacagagaaaactaagataccatacagtaagaaattcatgagtccatctgaaggatggatggatgggaagatgaatggatggatagaaatagaaaggagggagggagggaggaagggagggagagagggaaggaaggaaggaaggaaggaaggaagggagggagggagggagggagggagggcgcggtggctcacgcctgtatcaggagaatggcatgaacccgagaggcggagcttgcagtgagctgagatcgcgccactgcactccagcctgggtgacagagcaagactccgtctcaaaaaaaaaaaaaaaagaaaagaaaaaagaaggaaggaaggaaggaaaataaaggaaagaaagaaaggaaggaaaggagaggagaggaaaggagcagaaggggggctcttctttacaataaaatgccaattaataaatcattttacagccatcatgacaaaatttgatttgaacaggaatcatctatgtatgctaaatccaagagagggaaaatcagagaaggagcagcatatttgcacggtcataatatctcatgttaattgttacatactaaacaactgtgagaagcaaaaatagtaactatacagtgaaactggaccaaactttggccaggaacttggccttggggctaagaggctcaaaataataccctgagaagaatatgacctcaatctcactatgtactgatgcaggaaagattgcataatctaaatctcactgtgatgaaacattataaaaataagttgaggccagtgtcatgaaagggtaaggaagtgtcccacattaaaggaaacaaaaagatatcattaaatgcagtaagtgatcctggattagattttcatattgaacaaaaaacatgctataaaagacagcattgggacaactgacaaaatatattaaagtattgtataatagttaaattccagccatgtgcaatggctcatgcctgtaatcctagcactttgggaggccaaagcaggaagatcatatggggccaggagttcaatagcagcctgtacaacatagcagaactctgtctctataaaaaaatacactgggcacagtggtgtgcacctgtaatactagcaacttgggagggtgaggtcagaggatcacttagggctgtgaatacgaggttacagtgagctatgattgtgccattgcactccagcctacgtgacagagtgagatcatgtttctaaaaaaacaaaactaagaataaaaaaaaataaaaagttaaattattaaatttggtaactgtgctgtgtctatataagagaatgtctttatttttaaaaaacacatactatattatagtattgcatattattcttatttttaaagcaagtttattaggaaagtaaaggagtaaaagaatggctactccataggcagagcagccagtttcgcagattaaaggagcataatgtatgcaacctactctcaaatggtttataaaaacatgaatgcaagcataggtgtatatatgtgtatgttgtttgtgtagagagagagaataataaagtaaatgtggcaaaatgttaaaaatatgtgactctaggtaaaacatacataaaagttattctctatttttgtgacttttctgtacatttgaaattacttcaaaaagttgaaaaaaatacagcaccaagtaactataaaaaatatactttagtgacagaagtcagatcagtgattttaatttaggaggatggggttgtttagaaagaggcctactctgagtgatggtaatgttttatatcttgactgaggtttttgaaaacacaggggtattcagtgtatcagaatctacaaaactgtgcacctcaaatccatatattttattaaattaaattatacttaattttttaagctaacaaggaaatttaaagcttggcaggagatgaaaattaatgatcaaaattcataatagtaagcctacctaaaaatgaacttgaggtttgaatttgtattacctgtgtgatcttggaaactgcaagccaagaatctaattttgcaaatcctccattgaagaatttactcatttacatctctcaaaatttccacagactggccaggcgtggtggctcatgcctgtaatcccaccactttgggaggccaaggcgggtggatcacctgagatcaggagtttgagaccagcctagccaacatggtgaaactccatctctactaaaaatacaaaacattagccaggcgtggtggcgtgcgactgtaatcccagctactcggaaggctgaggcaggacaatcgcttgaacacaggaggcagaggttgcagtgagccaagatggcaccactgtactccagcctgggcaacaagagcaaaactccatcttaaaaaaaaaaaaaaaaaaaaaaaaaaaacgaaatccgcagattaagattatttattaaaacaaaatttaagacatctgcaaatacactgggaaataaaccatcacataaaacaataaaaggcaaaattaacctctaaaggacctcaaatatgcaaataagtatgacttacataaataagtatgttctaaatatttaaagaaatacgacacagaaccaaaacattgcaaaaaacaagacactaccaacataagcaggcagagctgaactcgatattctaggagttaaaaatatactttctgaaattaagaacagaaagttaaatgtccctgttctccaatttcaagaaaggaaaggactaactgttctctggtagtcagctaatccctaaactatacacagaaatttcagacagtccttaaacactcctgtttttgaaagtcttcaggcttccaaagcccaatgcgataccaactcttcgctttgtttagaatgtcatggctaagaagcacagttctcccttgcttatcaagaaagaaattgagtggtttctcatttcaagtatattgagtgatggtctcatccttaagagaatccaataaattaattaacagcaaaagataaaatcagtaagcttgaatatggctaaatacaaaatatcaaaactgcagcacacacaaaaaaagataagagatatacaggacaccgaaagagcaattaagtaaatgtaaaaataattcatattcatggaatgaaatactctgtattataaatatataaattctccccaaactgatctatagatgcagtaaaactccattcacaaatccagcacttttgtgaaaattgataaatgacttctacaatttatatgtaatgcagagtcaataatagctgagacaattttgaaaaagagtaaggctgaaagatttatactgcctgataccagaatatttattataaagctacgctaagaagtatgaagaagtatggtactgacacaaagatggcaaacagagaaacaaaacaaagaatctacaactgcactattccatatggtaggcactaaacatgtaactatttaaatttgaattaattaaaattagtaaaattaaaaattcaatcattagttgcactagccacacttcaagtactcaatagccatctgcagtgaatagctactgaattaaacagtacacataaagaatatttccatcacagcggaaagttccattagacagcacttatctagaaaggtatacacataaaattacttgatttatgacaaaagtaacattacaatgcagtaggaaaaagtcttttcaataaattgtgctggatcaagtagacattcatatgtaaaaataaatttaaaaataagtaagtgaggctgagcgcggtggctcacacttatcatcccagtactttgggaggccaaggcggacagatcaacggaggtcaggagttcgagatgagccaggccaacatggtaaaaccttgtctctactaaaaatacaaaaattagctgggcatggtggtgtgcacctgtagtcccagctactcaggaggctgaggcaggagaatcgctggaacccagaaggcagaggttgcagtgagccaagatggtgccactgtactccagcctgggcgacagcgagactctgtctctaaaaaataataaataataaataaataaataaataaataaataaataaataatcctgatgtctacttcataccatatacacaaaacaattccaagtagattgtaaatcgaattagtgtaaaaattaaaacaataaagcttttagaggaaaacacaggaaatctcttcatgactttgtagtatgttgcgggaagtcagggatcccaaatggagggaccggctgaagccatggcagaagaacataaattgtgaagatttcatggacatttattagttccccaaattaatacttttataatttcttatacctgtctttactgcaatctctgaacataaattgtgaagatttcatggacacttatcacttccccaatcaatactcttgtgatgcctgtctttaatctcttaatcccatcatcttcgtaagctgaggatgaatgtcacttcaggaccctgtgatgattgcgttaactgcacaaattgtttaaacaatatgaaatgtgggcaccttgaaaaaagaacaggataacagcgatgttcagggaacaagagagataaccattaagtctggctgcctgagagccggggccatatctctcttctttcaaaagcaaacaggagaaatttcactgaattctttttctcagcaaggaacatccctgagaaagagaatgtgttcccaagggaaggtctctaaaatggccgctttgggaacatctatctttttacggttgtagataagggatgaaataagccccagtctcccatagcgctcccaggcttatcaggacgaggaaattcccacctaataaattttggtcagactggttgtcttctctcaaaccctgtctcctgataagatgttatcaatgacaatgcgtgcctgaaacttcattagcaattttaatttctccccattcctgtgatctcgccctgcctccatttgccttatgatattttaccttgtgaagcatgggatctctgtgacccacaccctatttgtacactccctccccttttgaaaatcattaataaaaacttgctggttttgcagcttggggggcatcacagaacctggcaacatttgatgtctcccctggacatccagctttaaaatttctctcttttgtactctttccctttatttctcaggccagccgacacttagggaaaatagaaaaggacccatgttgaatactgggggctgatttccccaaacagtagtagacaaagatttttaaaatttgatgaaagaagtgccagccatagaatgaatgcggataaagattatgtaagatgacattaaaattgagaatctctgcttatcagaagacatcattaagacaaggaaaaggcaaaacacaacctgagaaaatttacttgccataaatatacctgataaaagactcatatccagagtatacatatgacaaaaggactcctacaaaacaataagaaaaaggcaaatagacaatccagaagaaaaacagataagaaatgaacaggcatttaaaaaaagatgtccaaatggctaataagcgtatgacaaggtattaaattttacttatcatcagagaaatgtaaataaaaacctcaatgtacatcactatatacctaccagaatatctaaaatgaaaataaagataggcaaaatgaagtgttgatgaggatgagatataagtggaactcttaaacactgttgatacaagtaaagattggtgaaattacattggaaaatgtttagcagtggtatggtttgtattatgtatcacccaaattcatatgttgaagttcaaacccccagtacctcagaatgtgaccttatttggaaatatggtcactgcagacataattacttaagatgaagtcattagggtatcaccaatgtaaccaatatgactagtgtccatataaaaaaggcaaatttggacccagagacataaacagagggaagacaatgtgaatagaaataggaagaaaacagtagcctacaagtcaagaaagagagccctggaaaagacaattccttcacagctctcaagaggaacaaaccctgcccacaccttaattttggactgctagcctccaaaactgtgggaaaataaatttctgttgtttaagccacccagttgcggtatgcttttatgatagtcctagcaaactaatataggcattatctactaaagtggaaaacatgcacaacctatgacctaacaattcttcttggtagatatacatcagaaatgtgtatatatattcaccaaaagatttgtataagaacattcatatcattactattctatgagccccaaactagaaataacccaaatgctccatagtagaatgaataaattatggtatattcacatgatgggattttacatggcaatgagaatgaacgaactacaaccgcatacaaaaacatagattgaactcacaataatgttgagaaaaacaagatacaaaagaatatacaattacaataatatagttgaacaggcaaaagcaatctataacgttagaagtcaggatagtggttacttttcaagaaaaaggagatagtaatgattgggaagaggcaagagggaggtttctgtgatgctggcaatgttctatttctcgatcttggtgatgctatactgtgaaaattcttcaagctatacattcataatctatgtacctttgtccatgtaaattacatatcagtaaaaaaaaaaaaaaaaaaaaagtactttaaaaaactgaacaggttggttaaacagcagattagaccagccggttgtgaattctatgagagaacttgaaaacagtcataatgtagcacagacagagaaaatataagagacattaatagaagcataggatgaagtaaaaaggtcaagtataaatctaactggaattgcagcagacaaaacaaatgggggagaagcaatatttgaagagggaatagctgagaatttcctagaatcaacagacacaaatcccagatttaaaacgcacaataatcctaaacaggataaataaaaagaaaaccatactgaatagagtatagtgaaactacagaactccaaagacaaagagaaaatcttcaagtcagatgatgcacaaaggaacaaaaattagactgatttttttttattttgaaaaatttcaaactcatagaaaagctaaaaagaataattcaatgagtgtaccccacagattatgccactcaccaatgaagacacccaccagaatatactcctcactaaattcacactgttaacattttggctcatccactcaaaatgtttctgaacataagtccttcccttttgggaaaatgtagaaagtatagcactaacaatagcactattattctttgtctgaaaattctttatcatgcatttatcagaaacaagaacattcttctattcaatgacaacaccattacctcatctaagataatcaacattaatccaataacaccatctaaagagagtcctgatgaaattttcccagtgatcttaaaagcgttccctaaagcttttctttttgctgatccaggatctaatcaaggctcgtgcattactttcagatggtatagttattaggtctctctcaatttagagactttccttgatacactacttcctttgatttttgatgacactgaatcctttgaagagtccaggtcagttgtcttgaaaaaatgttctacattctggattagttggactgattcgccatgattcctagatcaaatgtttccagtaagaacaccacataaggtaatgttacgtctctcccgtgcaccacattatgcatgtggctgtcccactattagcaataccaagctcggccattttgtaatttttccctttgtaataaataagtcatctgtaaggtgatattttgagactcaagggtattatcaatgacaattatggaagccagaagacaggaggataccaccttcaaagtgctaagaaaaaaataactattacagcagacctatattgccaatgaaaatattactgaagaatgaactcaagataaaatatatccttaaattatttttaaatcctgaaattattatttcatgggcaagtaaacaaaaaacttgatgggaaacattgccaagtttccatttgccaaaaaacataataaaaaatttccactactaacatcatgctttccgaaaagaaaggacaattctaagcttccaaaaaagaagacttaagctcaaaataaatgaaagttctctaaaatgaatgaattttgctttatgaacagcacactttttattttctcattttgctacatgtatccatattttgttaggactggttaacagtccagggacaagtgtttggaaattactaagtctagctatgaaaaagggaaaaggcattttatttcaccattatgaagaactcgggcttcttttttaaccacagtaattaggattataaaatccatttcatagttaacgaatctgaagtatgaattgttaaagaagcatgcacagcatcacagagatagtaagtggctcagatttcaaccaagtctaaacctaaagcgtacgttctttctactccgccatagtgagaagcccaaccacacaagtatgaaatacctaaaggagttaaaggctgtcaaatggcagtttaaaatatcatttgtgactgaatcttcaggaatctgaggaccgttaacactgtgaatatggaagagtacaacttttctaactccataaaagcaatggaaatctacagaagtgatgtctaggctggaaaaactgagaagatgcaggtgtaaggtgaaaaacaccagatatataaccttaagtgtcaactaacagctataaatacaaatgtgtacaatagacacaaactactaatacatgaatctcactcagtaagattacaataattttaagaagtttttcataaacagcacatattactggattccatttatataaaccattaaaaacaggcaaaatacaaaacatcagatcaatgtgagagtggggactgactgagaaagggaatgaagtaactttctaggatgatgggtttgggttataagagtatatgcatttgtcaaggtttgtacatttcattaattaaatctcaacagaaaaaaaagtctgtaaacaaatacgaattctggttaatcatacatatatttaagtatatatgggaaagtataatgatgtctgcaatttactttgaaatgaatgaaaataataaaagggactgatgggacagaaggatagaaggatggattcatagataaatacgtgatagaccaagcatggcaaaatgttaataataaactgtgggtgttgcctctaccaagcatttactctaacattctttcaactttgttgtatgttttttaaactgttcataataaaatgttgaagagaaagtatatgatatatgtgactgtggaactaagacaatgttatccttaaaaatatagaaaaccatataatggcccaatttgatggaagagatcatataactatcacaaagtttgaaaaaagtaaagaaatacagacagtagtataaggtactcataaaacacacccagaagttgctaaatctaaggtggaaaataaaaagaataagaatacaatggatgggtgcagtggctcatgcctgtaatcccagcactttgggaggcggggcagaaggatcacttgagcccaggagttcaagaccagcctgggcaacatggtgaaaacccatcccttaaaaaaacacaacaaaaacaaaaattacccgggtgtggtggcgtgcaccctgtagtcccagctattcaggaggctgatgtggcaagattgcttaaaaccaagagacagaggttgcagtgagccaagatcgtaccactacactccagcctgggtgaaagggcagagtctattaaaaaaaaaaatccttctggtaatagacaaaaaaacaaaaaacgatggaaataagttgaattagtttcatgtgaaagcaatacattctagaaaactgtcaatatatgagttgctgagagtatctgataactgaaataattaagataactgaacatactttctcttaagaaatcacaattggttcaatatatttcaacatgaagtataagtcaaccatagtaaatggataaagctaacttggtcacaatcaattctactaaagaaagactgtgaatacacgaaaagaaagtttgaacagaactttgtttttaatacactttccaggaatttaacatttttagcatgtcttcaaagaactttacctgccatttcttttgagggcaaaaatgatgccatctttctggaatggaagtagctttgctcttagtctgtcaggcaaaaaatccagcagattatcagattcatttgtcacacaagaaatgtgaggtgtaagagacttttttatgttatgaaccctaggcatgatgatcctaaaaacaaagaaacaacaaaaaagggaggggtataagaaatagatattactaagtatgttacagaatcacatataaataatattaaagtacttataaatagctttgacataccatttatataaactaaatcatattctcacagtaagctactaagaaaattcaaagcactgagtttgaaagcaattacttaatgcactctctaggaactcagcatgcactatttcattttgagccataataccatatactatacaccagtttaacaccacaaatttattactaaaaaattataaataaactagatttttcacaaatcgaataatttttaaaataagggatgaatctgctagagaaagatgaatcctttaataattcatccttttatggatccacattttcatatcacaccagattttctaagagtgaggtaaagctacatttaaaaaaattataaaatacaaagacattaactccaaaatcaaatttatactaattaaattaatgtaatattattaaattgtttaaatattaaaattaattctttttaatgagctgaatccacagtatagcactttgcctgattaacaccttcctcaccccctggttttccacagatgttactgtaattttctatgacataaaaatgtcatatatctgtaaattcttataactctggaagaaaatgtcctattatacaactacactataatgcctatcaaataataatattttgtatttagatggtaccctgccttctgtttatatattatctcatctttaaaaaaaagtttgcgggccaggcgcggtggctcacgcctgtaatcctagcactctgggaggccgaggtgggtggatcatgaggtcaggagttcaagaccagactggccaatatgttgaaaccccatatctattaaaaatacaaaaattagctgggcgtggtggcgctcgcctgtagtcccagctatttaggagcctaaggcagaagaatcatttgaacccaggaggcagaggttgcagtgagccaagatcatgccactgcgctccagcctgggcgacagagtgagactctgtctcaaggaaaaaaaaaaaaagtttgcttttttcctcaattacatgcagacttatataactattgctctcttccatccaaaaaagtaaccaacttctgtgtctactaagaaggtcaagaacaaagcaagtatttatttattaataacaaataggtactacatgccacaacctagagaagcaagacccacgcactcgtagggtttatattcttcaggggaaaactaaaaattagcaaataaataaatatgacggtttttcttttttgttttcagctacacctgatcgaatgggaaggatgattaattataatatagcacaaatagtgtaaggaatttaagagagtactggtcactttaggtaggctgaccaagagtggcctgtcttaggaagtgctgtttggcttatggtctgaaagatgtaaaaagccacccaggatcaaaattaagagaagagcagtccgaggaaagagcatcactgcaaaggacccaaattgagaaagggcttggtgttttcggaaaacagaaagaaggctaaggtggaccagacacagcagttcatgcctataatctcagcactttgggaggccaaagtgggcggatcacctgaggtcaggagtttgagaccagcctggtcaacgtggcgaaacactgtcctactaaaaatacaaaaattagctgggtgtggtggcacaggcctgtaatcccagctactcaggaggctgaggcacaacaatcacttgaattcaggaggaggaatttgcagtgagctgagatcgcaccactgcactccagcttgggtaacagagcaaaacttcatctcaaaaaaaagaaaaacaaaagccaatgtggctgatgatccaaaggagggaacggtgtaagatgaagctaccgagataaacaagagccaaatcatatacagccttgataataactttggattcctttttaagaaggaatgctaatggagttgtgctgtcgcatacaccattaacaaaatgtttaattaaaattaaaattaaaaattcagttatccagtttcaccagccatgtttcacgggctcaacagtaacatgtgtctggtagctatgatatttaatagtaaagatacagaacatttctctcttcacttaaagttctattggacagtactcaatggaaggtttaaacaggggaatgacacaatctgacttacatttcaaaaaacacctgaaggagacaaagatatcaataaggaggcaggagataaatgttcttataggatttggccactcaacaaagcctccactgcttcagtaggcaattgaatttagaaatgatttatgagtcagttctgtctgaataaggtcctcataaacactcatgagtggccctccctaggaccctctcaccaccaccacccccataacaaaacttagcaaggaatagagaatggagcaaaaagggaaagcatgaaagcaggaaaactgttttcaggttgcaacagacaaggcaaaaaacctttagcagtgaaactgaaaagattcacgaagtatatcagaggtaaagcaaacagcatctgctgatgcggtacatgtagagaataacagaaatgtagaatcaaaatgtggacctagagtgatggagttagtgatgcaattggctgggatggtaaggactacagaataaataaattgggtagaaaaaaaatccacagattttctttgagatggctataagataagaagtggaaatgttgggtatgcttgaaaatatatgagtctgaagttcctatagggagagatagagaatggatacacacaagaaatatcagacactttcccagcctgccttagagctactaatcagatatactattgtggactttagaaagtcaaaactcaaaggagcagagattaagtaaaattccttctggcaaggctaacagcagcagaaaaccatgtccactttccagaagtaacaggagtttcagaagcactttttagggtcaatgggataaaggatgtaatgttttagggtggaacactggcaagaagttaagtaaaaaattttaaaaaaaaatgttgctgtctatcatctttattcaagactcctttttttttttttctttgctgggtgcagtggctcatcgctgtaatcccaacactttgggaggttgaggcagaatagcttgaggtcaggagctgaagatcagccagggcaaacagcgagatcttgttgcttacaaaagatcataaaattagctggttgtgggggtgcatgcctgtagtcccaactacttgggaggcttcagaggactgcttgagcccaggaatttgagctatgatcttgtcactgcactccagcatggatgacagagcgagactctatcaagaaaagaaagaaaagaaaagaaggaaagggaaagaaaagagagagagagaataacaaaacaaaacgactcctttacattttacttagtaaaaaattttaatagacactccaaaaaaatctggtaaattggggtcactttgccacttacatgatttatttttatgaggactgactcaggcacaatatttgttttttgttttttgttttttttcttttgagatggagtctcactctgttgcccaggctggagtgcagtggcacgatctcggctcactgcaagctccgcctcctgggttcacgccattctcctgcctcagcctcacgagtagctgggactacaggggcacgccaccatgtcaggctaattttttgtatttttagtagagacggggtttcaccatgttagccaagatggtctcaatctcctgacctcgtgatctgcccgcctctgcctcccaaagtgctgggattacaggcgtgagccaccgcacctggccaaggcacaatatttgtaaaaataaacaatgaaattaaagttatattaatcaaaaatttgttttaataggcacaaataagagaaaaaattaaatatgaagataaaagaaatctaaaacattatgaaaatgtacagaaaaaaatttcagttgaatttaagattatagtgtggttcattgatgatttaaacagatatttggataaataaagaacttaaaaatatgtagtggtacaatgtaatgaatagaacatgaatgtttttgttaatcctaaaaataatttttaaaatattcttttctatttataggatctaaagtaaaaaaggtgtaataaagaatatctcatgtaggttcagccatataggtttaattgctacaaaaagtcagttgtaatcaacattacattaataaaagaagatgcacattttaacttcattctagattaccaagaaattaacagttacaataatgtgcatacctttttaataatgaatactttattcagttcaaaggtttaacttaaaaggttttattcaatatatatatactaatttacttatagcaaggcggggggagcctatcaaaatgaaaccaggaatacataatttaaaaaaaaattttcttccagaaatattttaataaacattgaccatttccaagaaacacccactgcatgcccaccaatgaaagagaatcataacaaaatagaaaatttaccatatggctatgatttaaagaaaaaaaaatgtggacaggagcacatcagcaaagtccattattaaagtcacattccttcttatgggctatgaataggagtccgattagataccagaataaaacttactacaaatgctgaaccatttaggtcaaagaacctctacagaagcatctgtcttcaaagggattctagtttgagactcaattttagaataaggtataacaaataatgttaacggaagacatacaaggtgataaaagagggtttctacaattccccacatgaagtataagtcaaccatagtaaaacctaataaaacaaatctagatattaaaaacaatatctgaacctaataaaacaaatctagatatattaaaaaattatttttctttaaacaattgccaagactaaaatcaaagataaacagaaggcacaacagttttgttctggttgttatctgggttttgggaatattttgtcttttgtttttttacaaatacaaattaaacatgaaaaaactctacttcaaaaaaactaacagttcaagaaaagcccatccagttgcattctagacatttaaaacctataccacaatataaatttcaatggtaaaaacggtaggttttagaattgttttgtgatcctatatcaaaagaaaagttctattccttttattgtttttaaacataccagcaagaatcaaaattgtcaaattttccaaattttaaacataccagtgagaatcaaaattgtcaaattttccaaacccactgtaaaaacaggttttagaagtgtttcgtgatccaatatcaaaagaaaaattctattctttttattcagtttttaaacataccagcgagaatcaaaattgtcaaattttccaatggcaatttctccacaccagaaagtggttgtgactctcaaagaagtaacaatttggggttttcctgccttcaaaatgttatcaaatcctgtatttctcacaggcttttgaaacacacagaaagtaagaaatattccaatgaatgaaacgtaccaaatgtcagtaatacgcaagacacattcctttggggaaatggctgttaggaaaaaaatccagtctgtacatgcaaaataagcaaggaaattcagtctttctttcttcttcttcttgaaaaatccgttactcctaaaatatcattccacaaaattggaagtgaaagactaaaggtcaggaaagggaagagagggagaaggagcacacatcattaacacacaaaagaagtaaaattatactaacttaagcagtttataacaaactggggtcatactccaagataccaaaggctggtcaaagaaattcaccattctgtaggagctagggtttgtatggccgcgtgaagatccatgaagattcactgccatggagcaagccttcttcccactccaaatcctgctttctgcaccatgcctccatgaggagggcctctcattccaccacccagcccacatagagggcctccaggtcccctaaggcgatcatctcgtcagtccccttccctggcagctcgagtcttcttctcttccacattcagacagacctcacctctgaacatgatgggcctgttgcgaaggaccttctgaacaggctcagaatcatcaaaacaaaaccaaaactgggtaatttcccaccactgttaatgtgcaactccaccacgttcccataattttgaaagaaatctttaagctctgatttgtccacttcatgaggcaggttgccaatgaagagttggtgactgtcagggtgtctcaccactctttggggttcaatgtcaccttgctcaccagcctcacagatcggtctgggtcccctttggggaggaatatttcttcgttgttctcacatcctttgatccctttgaggtttctgtggtggaatctgagattcaggcttagactctgtacagggctgtgaagctagtactttaccaacataaggaggtatcccagtaactggaacagctccactgggttgaaggttgttactggtcacagatgcccaagaaaatgtcctcaagtcttcccatactgtctgagatatgtctgcaggtgctggagaagaactcttctgagcatcctcaggagcagtttcttctaatactagctcagacttttcctcttggatttcagatacacattcttgttctggttctggctcaggatcaggctccagttcagcaactggctcctctaaatgttcttccacgtcattactgacaactgcctgatcacagaaagttccagaatcatcaggtaccacctgaggtgtttgctgtcttttcttcacgttcctctactacttcttcagactcctcctgaggctcagtgacaaacccaccaaagacctcatcttgctatctgaagatatcattgtgaacatagaactgatttgcaacagacccctcaggagcaagtacgaacatctgcatgaatctcctcaaagcctggttgttgttagacagaagccccaacacctggactaccacaccatcatttagtgtggcataagcatcaacatggagaatcttggtgtggcagttgctgaagtttcgtgacatcactttcctgtggatttctttctgtccataaactgcatctgctagctttctatttgaatccaatcccccatggacataagaagagttccttccataaaatctatgcagcatgtctggggcctagttcagcagtgtgtaatgctgtctcacaaattcccacccaaccagcaggggactagccttctccatcaccattgctttggtcaattcaaactgaggggaaaaagtcaaatatgtccaaacctgtgcggctgagctggagaggaactaactctgctacacagcactgatgatggcagaaacccctcatgcaactgtgtccgcaccagcaatacataatttttaataccatgttattaaaatcaaaatgacaatattggctagggaaatttagtgaaagcaaaatctagtagaacttattttctaagcaatttgcttggtatggtacgcaacacttgaaaaaaagaaagaaggaaatactttctatctttttaggtcaagatagtgtttttgtactcaattgagaacaaggcaaattcaactggaattcactgactcatttaagtaaatagtagaactgtactgaggagaatcagatattgttaaaatacactacctagagacttatttcagaaacaacaagtaaatggcgggtcaggacaactatataaactttggggagataatttttttttttaattaagaatgtattggatgaaatttactgcagaataaagaattagtaaattagaaaagatattaaatgtaaatggactaaaaacaaatgaaaagattcctatattaaattaaaatatatataaatttacatgttgcttttaaaagacatacccttaaataggaggattcataaacactgaaagtaaaagaattaaaaaagacatattatacatgccaaagtatagctagtattgctttacattataagataacataggtttcaggcaaaaaaaaattattaaaataaagaaaagcattttataatgataaaagatttattagaaaaatttagcctcaaaatatatcttaataaatatacaaggcaaaaactgataaaaataaaaggaaaatttgacacaaccatatctatctataaccacagtggaaaagtttaacacatgtctctcagtaattgattatgcaagttgattaaattgtaacaggataaagatgatttcaagaatacaataaacaaatctgacccatttggtgcaaagacaggagtattattttcaagctcattgtgtgaagccagcctaaacaatctcacaagcacattacaagaaaaaacatacataatacaatctctcatattcataggtaaacaaaatattagcaaaccaaatatagcagtaattaaaagactaagacaccaagactaaaatgggcttatttcaggaatgcacagctgattatactttcaaaattcgatcactgacaagctgattctaaaattcatatggaaatgcaaggaacccagaatagccaaaacaatcttgaaaatgaacaaagctagaggacttctacttcctggttgtaaaatttactacaaagtgacaataatcaaggcagtgtagcactactagcataatgacaaccagctaggtcaatggaacagaactgaaagtccagaaataagcctttacatttacagtcaattttttgacaagggtcctaagaggattcaataggaaaagagtaactttttcaacaaatagtgctgagacaactagatgttcatataaaagaatgaaattaaacccccacctcatgctgcatatgaaaattaacttaaaatggatcaaagattaaaacataacagttaaaactataaaacttcaaggagaaaacacaagagtaaacctttgtaatcttgggttatggtatggttttagacaacaacactaaaagcaaaaacatgaagtctttgaacatgcctatgtcctgaatggtattgcctaggttttcttctaaggtttttatggttttaggtcttatgtttaagtctttaatccatcttgagttaatttttggataaggtgtaaggaaggggtcctgtttcagttttctgcatatggctagccagttttcccaacaccattcactaaatagggaatcaataggaaatcctttccccatttcttgtttttgtcaggtttgtcaaagagcagatggttgtagatgtgtagtgttatttctgaggcctctgttctgatccattggtttatatatctcttttggtaacagtaccatgctgctttggttactgtagccttgtagcacagtttgaagtcaaactaggtagcgtgatgcctccagctttgttctttttgcctaggattgttttggctatacgggctcttttttggttccatatgaaatttaaagtagttttttctaagtctgtgaagaaagtcaatggtagcttgatggggatagcattgaatctgtaagttactttgggcaatatggccactttcacagtattgattcttcctatccatgagcatggaatgtttttccatttgattgtgccctctcttatttccttgagcagtggtttgtagttctccttgaagaggtccttcacctccattgtaagttgtattcctaggcatttcattctctttgtagcaattgttaatgagagttcatacatgttttggctctctgttggtctattattggtgtataaaaatgcttgtgatttttgcatactgattttgtatcctgagacactgctgaagttgcttatcagcttaagaagattttgggctgagatgatggggttttctaaatatacaatcatgtcatctgcaaacagacaatttgacttcctctcttcctatccgaatatcttttctttctttctcttgcttgattgccctggccagaactaccaatactatgctgaataggagtggtgaaagaaggcatccttgtgtgccagctttcaaagagaatgtttccagctttcacccattcagtatgatattggctgtgggtgtgtcataaatagctcttatcacttttagatacattccatcaatacctagtttattgacagttttttttagcatgaaggggtgttgaattttatggaaggccttttctgcatctattgagataatcatgtgttgttattggttatgtttatgtgatggattacgtttactgatttgcatatgttgaaccagccttgaatcccaggaatgaagctgacttgatcttggtggataagctttgtgatgtgctgctggattcagtttgccagtattttattgagtattttcgtatcgatgttcatcagaaataatggccagaaatcatctttttttgttgtgtctctgccaggttttggtatcagcatgatgctagcctcataaaatgagttaggtaggagtccctctttttctactgtttggaataatttcagaaggaatggtaccagctcctcttagtacctctggtacaaattcggccgtgaatctgtctggtcctgggctgttttggttggtaggctattaatagttctctatttccttcagttctgctctgatcttagttatttcttatcttctgctagcttttgaatttgtttgtgatattagggtgtcgattttagatctttcctgctttctcctgtgggcatttagtgctacaaatttccctctacacactgctttagctgtgtcccagagattctggtacgttgtgtctttgttctcattggtttcaaagaatttatttacttccgccttcatttcgttatttacccagtagtcattcaggagcaggttgttcagtttccatgtagttgtgcggttttgagtgagtttcttaatcctgagttctaatttgcttgcactgtggtctgagagactgtttgttatgatttccattcttttgcatttgctgaggagtgcattacatccaattctgtggtcaattttagaataagagtaatgtggtgctaagaatgtatattctgttgatttgcggtggagaattctatagacgtctattaggtctgcttggtcctgagctgagttcaagtcctgaatatccttgttaattttgtctcattaatctgtctaatattgacagtggggcattaaatctcctactattatcgtatggaagtctaagtctctttgtaggtctctaagaatttgctttatgaatctaggtgctcctgtattgggtgcatatatatttaaaacagttagctcttcttgttgtactgatccctttgccattatgtaatgcccttatctcttttgatctttgttggtttaaagtctgttttaccagacactaggattgcaacccctgttttttcttttttttttggctttccatttgcttggtaaatattcttccatccctttattttgagcctatgtgtgtctttgcacgtgagatgggtcttctgaacacggcacactgatgggtcttgactctatccagtttgccagtctgtgtctttcaattggggcatttaaggttaatattgttatatgtgaatctgatcctgtcattatgatactagctggttattttgcccattagttgatgaaatttcttcacagtgttgatggtctttacaacttggtatgtttttgcagtggctggtaccagttgttcctttccatgtttagtgcttccttcaggagctcttgtaaggcaggcctggtggtgagaaaatctctcagcatttgcttgtctgtaaaggattttatttcaccttcacttttgaagcttagtttggctggatatgaaattctgggttgaaaatccttttccttaagaatgacgaatattggaccccactctcttctggcttgtagggtttctgctgagagatccactgttagtctgatgagcttcccttcgttacccaggtaacccagcctttctctctggctgcccttaacattttttccttcatttcaaccttggtgaatctgacaattatgtgtcttgtggttgctcttctcaaggagcatctttgtggtgttctccatatttcctgaatttgaatgttggcctgtcttgctaggttggggaagttttcctggataatatccttaagtgtgttttccaacttggttctattctccctgtcactttcaggtacaccaatcaaaaatagtttggtcttttcacatagtcccatatttcttggaggctttgttcattccctttcattcttctttctctaaccttgtcttcacactttatttcattaagttgatcttcaatctctgatatcctttcttctgcttggtcaatttggctattgatatttgtgtatgattcacaaagttctcatgctgtgtttttcagctccatcaggtcatttatgttcttctctaaactggttattgtagttagcaattcctctaaccttttttcgaagttcttagcttccctgcattggggtagaacatgctctttaagcttggagaagtttgttattacccaccttctgaagcctacttctgtgaattcatcaaactcattctccgtccacttttgttcccttgctggcgaggagtgatcctttggaggagaagaggcattctggttttgggaattttcagcctttttgtgctgttttttcctcatcttcgtggatttatctacctttggtctttgatgttggtgaccttcagatgggatttttgtgtgagcgtcctttttgttgatactgatgctactcctttctgtatgttagttttccttctaacagtcaggcccctctgctgcaggtctgttggagtttgctagaggtccactcaagactctgtttgcctgggtatcaccagcagaagctgcagaacagcaaaggttgctgcctgttccttcctctgggaggaggcactgccagatgccagctggggctctcctgtctgaggtgtctgttgacccctgctgggaggtgtctcccagtcagggggcatgggggtcagggacccacttgaggagacagtctgtcccttagcagagcttgagtgctgtgctgggagatatgctgctctcttcggagccaacaggcaggaacatttaagtctgctaaagctgtgagcacagctgccccttcccccaggtgctctgtcccaggaagatgggaattttatctataagcccctgactggggctcctttcttttggagatgccctgctcagagaggaggaatatagagaggcattctggctagagtggctttgcgtgctgcggtgggttccgcacccagttcgaacttcccagcagctttgtttacaccgtgaggggaaaaccgcctactcaagcctcagtaatggcaaatgcccctccccctaccaagctcgaccgtcccagatagacttcagactgcgtgctggaagtgagaatttcaagccagtggatctacttagcttgctgggctccatggggtgggatctgctgaggtagaacacttggctccctagcttcagccccctttccagaggagtgaatgattgtctcgctggtgttccaggagccactgtggtatgaaaaaaactcctgcagctagcttggtgtctgcccaaagggctgtctggttttgtgcttgaaacccagggccctggtggtgtaggtaccctagggaatctcctggtctgtgggttacgaagcccatgggaaaagcatagtatctgggctggaatgcaccatttctcacggcatagtccctcacagcttcccttggctaagggagggagttccctgaccccttgcacttcccggatgaggaaacgccccaccctgctttggcttgccctccatgggctgcacccactatctaaccagtctcaatgagatgagccaagtacctcaattggaaatgcagaaatcactggtcttctgagttgatctcgctgggagctgcagattggaactgttcctattcagccatcttgccagccaccatagtcctgtaacttgtagttatggagctgggtcacaaactcaggtcatgtggctatagatgtcatatgccacattttcagctgctattctatacgcttcccctactgagaagatctatctgctgagaggcactgcagcatgttatttccttgtttgcttaatcttgcttcctacttctgtttgttgctatcaaaaattccaaaataatagggttcaggagggagaatttggagctgattgttggacaggggaaactgtttctgtccctcagattaggtgatttatcagggagagcccatttattatttttaattccatttattattttattccatttacacgacctacttgaaaggacaaaattttagaaatggataatagattagtggttaggttggggtgggatagaagtggttgtggctataagaaggcaacatgagggatcctcctgggatggaaatgttctctattttgactgtgtcaatatcctggttgtactgtagttttctaagatgttaccactggaggaaactagggaaaggtccacagtatctctccgcattatttcttacaatttcccgtgaatttacaatgaactcaaaaagtatgatcttttttagattaaaaaaaacaaaacaccctggcttgggcatgatgattacacctgtaatcccagaactttgggaggcagcagcagaaagatcacttgagccagggaggtccaggctgcagtgagctaaacagagcaagactcagaaagataaaactccaagatcatgtagctaacagcagaagtaagacctatatttgggtctttcatccctttttatcacacgaatgctccatctctacttcagggctaaatcccactgaaaatatctattttaaatattaatatactggtcctataaacagttatatcctatgaaaagtaatcatccaactccctgaatttcattttttcatgcattcaacaaatgtgtattcggttgttcacatgtagcagacattgtgctaggctccagatatataatagtaaatatattattacatgcagttctgaagaaagactacaggggaagtactgggtgttaagggagcatacacacgggactaatttttcagattagagtgtttggaaggcttctaaatatacatacatcaaagttcatacttcaacaacattaaccagagaggaagggatcaaagagtgttttaggaagaggatatggtatatataaaggctgtgaaccggaggtaaaaggaaggaagcaagcagtaaggaattctctgtcttcatcttaccggacctatcagtaatcactccctcttcattaaatcttttttttccacttaaattcttttttttttttttgttttggtcaggcacggtggctcatgcctgtaatcccagcactttgggaggccgaggcgggtggataatttgaggtaaggagttcaagaccagcctggcaaacatagcgaaaacccatctctactaaaaataaaaataaaaataattagccgggcatggtggcaggtgccttgcctgtaatcacagctactggagagtctgaggcaggagatcggttgaacccaggagacggaggttacagtgagccaagttcatgccactgcactccagcctgggtgacagagtaagactccacctcaaagagaaaaaaggatttctttttttttttttttttgagacaaagtcttgctctgtcactctgcctggagtacaggggtgcaatattagctcactgcaacctcaaactcctgggctcacacaatcctcctgcctcagcctctcaaacagcttggactacaggcatctgccaccacacctggctaattgtttttttgtttgttttttttgagacggagtcttgctctgtcacttaggctagagtgcagtggtgtgctctcggctcactgcaacctccggctcctgggttcaagcaattctcctgtctcagcctcccgaggagctgggcttacaggtgcctgccactgcgcccagctaatttttgtgtttttagtagagacggggttacaccatcttggtcaggctaattgttttttttttaatttttgttgtgatagggtctcattacattgccaaggctggtctggaactcctggccttaagcaatcctttcacctcagcctccaattactttaaaagcaagaatattacaatctttctttctacaggcaactgttttcagattaatgataaaataattcccacttattgggtgacctctttctgcaaaccactacactaggaaattttagaagaagtcttgaaattctcaaaacaactcataagataaatataattatcctcacgttaaggacaagaaaatttaaaagttcagaaatgttatataacttacacgaggtttaaaagttagcaactggtgacattaggcctagaactcaggttggtctaatttaaaagtctgaatttttgccattatgcaacattgcctctccaaatcactcactcaagaaatacttaagaagtacctattatggccgggcatgatggctcatgcctgtaatcccagcactttgggaggccgaggcaggcagatcatgaggtcaggagttcaagaccagcctcatcaacatggtgaaaccttgtctccactgaaagtacaaaaattagccgggcatggtggcaagctacttgggaggctgacagaggacaatcgcttgaacccgggaggcagacattacggtgagccaagatcgtgccactgcactccagcctgggcaaaaaagagcaaacttcgtctcaaaaataaataaataaataaatacctactatgcttcagacactacagaaggtattgggtaaacaatgatgaatttgtgccattgtagcctcacatccaagcccaggggaaatgacagctgtaaacaacacaacacaatgcgataagtgctatgaaaatagaatatatataaggcactacacataagagggaacattggctttatacggcagcaagtaatcaaaaaagccttcacttgtgagaaaaaatgcttggtatggtacaccttacttaaataccagatgccactcacgctaaaacttgaagagtggagtctgcagacagagaatcatgataaggatattctagagagtgtgggaaagacagtttctgggtgccagatgagttggtctcccctgtgtgagacacccatggggagccatgggcggcctctgaggagaaaagtctccttactgccttcatgtctttatgctcctagagcataacagctctgcagcatgccacaggttgctcagggaaataacactcccttgaagcaggggagtataatcaaacaacttggattctcctgaaacccactcccaccaatttcagtcccgaaaagttaaagatcttaagtagtttagacacacgcctttgctcaaggaaattcacagaaaccgccactgctataacatcttattgaatgactcacaagttctccttcactgattaatccttttcctcttcccttcctattcctcccatttgccctaagaacaaagagcttgtaaaccaataaattgggtggaggccaacagcttgaggctacgagcaagcctccgatgctccagtcccctggactcgccttttaaactcttattctgtctctttctaattcctttgtttctgctggacttggggtacccgccgggtggtgtggggctggtttccccaacagggagaaaaaagccacagttgcaaaggcataaagttttagaaaatctggccaggcaaggtagctcacgcctgtaatcccagcactttgggaggccgaggcaggcagatcacctgaggtcaggagttcaagaccagcctggccaacatagtgaatccctgtctctactaaaaatacaaaaattagccaggccgagatcacaccactgcactccagcctgggtgacagagtgagactccatctcaaaagaaaaagaaaaaaaaagttttagaaaatcctaagcagtttagtatagctaaagaataagatccttgtgacatgtagtaaagaagtaaaaacaggccaagtcaaagaggtgccatgctaagagtttggacttttttctgtaaggaattggaagcaatttttaaagtgtaatcagattgcgattttacaaagattaccttgtcaagtttagaaaaatgaatgtgggggcaggaataaccttttagaaggctaccacaaatagtccaggtaatacaattcataatctcttcatagactcctatatctaattacctacctgacattttggatatctccaatatccaaacagacatttttagcttaaaagtccaaaaccagtcttgatttctcaccaaatttgtgtgcccctgtagtctcagtaaatagtacaaccatgcaagttactcaaactgggtttcattcttgatttctccctttccctaaaccaccaagttgaatccacttattattcattattcccaaaatattaatgtatctcaagtctatccttttcccccccaagttccactgctatcaccaaatccaagccatcatcaccgctcaacaggattagcacaacagctcccaactggactcctctaaatttcccttaataccacttggtttccttaaagtacttattgtaattggcaattattcttctctgtttccttaaattttgtctctcacttctgttagaatgtcttcataaatcaggaatcatagactttcttatggttttatttcaggactctagcatctagcatcagcctgattaacggaaacaatattaataaaaaagcaacacacacttattatgtgtcaggtactgttttaagtattttatgtattaaatcatttgatcctcacaaaagcctctaaggtaggtattctcattatctcagttttacaaataaggaaactgagacacagatggtcaactaatctgcccaaggtaacacaagtaaatgacacaacaaagaatcaagcctaggcagactccagcctatagtcttgattattcagtacctctttcagtagatgctcagtaaatattccctgagcaaataaacacatgagagaatacagagggtagaacagatttaggggtgaagattgtgggccatgatttgggacatgctgaatttgaagtacttggagaaggctgtgaagtacagtgggataaacagttttaagttacagataagcatttagaagttatcaggttctcctggaagccacctacaaaatacaagtatctatatttaaaaagtgattatataatttaaaaaataagatgggcttttaaattgtaaccattttggtcgaattcttttttcttttttttttgagaaagagtttcgctcttgttgcccaggctggagtgcaatggcacaatctcgggtcactgcaacctgggcctcccgggttcaagctcctgcctcagcctcctgagtagctggaactacaggcatgcaccaccacagctggctacttttttgtattttagtagagacggggtttcaccattttagtcaggctggtctcgaactcccgacctcaggtgatccacccgcctcggcctcccaaagtgctgggattacaggcttaagccaccgcgaccatcctgtagaattctataatagaaatatgttttaacaaagcatagaatgacccattgattctcgatgacacccaagaaaaattctgtattgttactatgaaatgaaatacttggctttaagaagtcatatttggtatatatataaatgtcaaacttgcattttgttaaaatatgaaagtgcagagatttttaacttgacaaaaatctaactaataaattacaagaaaagctgagaataacaagaaaatgactgaaaaagaagagcgggaacacaccttacctctagacaccaaaacatattattacaaagttacagaaattaagataatgggtatggtacaagtcaaagaaaagagagaacaatgaaaaagaacagtgtccaaagagaaccatgtataaatgagaattgtgaatatgataaaattatattttaaattaatgggtatggagagatgaattatttaataaatggtattgggtttagcctaaaaaagattaatctttattttgttccttataccaaaaaaattacagataaattataaaatacaaaaatgttttaattagatatataatttttttactaatctggggtggggaaagcatttctaagcatcacaaataaattagaagctataaaaaaagatggatagatttggacactaaaataatttaaacttctagccataggaagaaaacattaaaaagttaaaagatatttcaaaatgggagtaaagatgtgagaaatatgacaaagaattaacagcctatgaagtaatttttaaaaaatattaagagacaatgacagcaacaggctacacaaaagagactaaacaccaaaggataataaacataaaaaagatgctctacatcaatagaattcaactagatacaaatgaaatataatgaaccatcaccttttagatcagattgaatagagtaaaacatgggaaatgggtgctctcaaacaccattagtaggaaagaaaatgggaacatcctttctgaagagcaacttagaaatcacagagtatttgtggctaaaaaacctacttctaaaaggttagattcaagggataatcagggaagcatacaaagagagtgcacatgacagcattacctataaaacctagtctattcagcaatcgtacttctgggtatatatccgaaagaactgaaaacaggattgggccgggcacaatggctcacgcctgtaatcccagcactgtgggaggctgaggcgggcggatcacctgaggtcaggagctccagacctgcctggccaacatggcgaaaccccgtctctattaaaaataaaaaaattagccggtcatggtggtgcgtgcctgtaatcccagctactcgagacagtgagataggagaatcgcttgaacccgggaggaggaggttgcagtgggccgagatcacaccattgcactctggcctgggcaacaagagcaaaactctgtctcaaaaaaaaaaaaaaaaaaaggaaatcctatcatgctctgcacagatgaaccttgaagacattatagaaagtgaaataaattagccacaaaaagtgaaatagtgtactacatgattccacttacatgaggtatctaaagtatgtagtcaaattcagaaacagaaagtggaatggtggctgtggtgcaaaggatacaggggagttgcagttgttgtttgataagtatagaatttcacatctgcaagatgaaaaagttctagatagctattgcacaaggtacatttaattgtacttgaggactaagctatgattttttttttttttttttttttttgagacggagtctcactctgtcgcccaggctggagtacaatggcactatctcggctcaccgcaacctccacctcccaggttcaagccattctcctgcctcagcctcccgagtagctgggattacaggtgcccgccaccacactcagctaatttttgtattttgagtagagacagggtttcaccatgttggccaggctggtcttgaactcctgacctcaagtaatctgcctgccttggcctcccaaagtgctgggattacaggcgtgagccaatgagcccaacctgatttttttattttacccaaattcctaactaaggggtctagggagtcatgccctacaaaccataaattctcatcaggggggttttatttgaaactatatattgtgatttatttttcaatctgactgtggcataacattatgagacaaggaagaaatatttaaccccaaaatatatttccttgccataccttaaaattgtcctgcaaagtctcttgtggttaaaatccatattctatagtgaatccccttccccctttgttttcctaccttccttcccaaatccagcagataatcaactaagagccagatacccttttaagtccgataaaaaacaatttacaacctgctctctctgaagtctgctatctaagagcttcctctgtacaataaaacttggtctccacaatcctttatctttaacctgagcattcctttctgtcaatcccaggtcttcaaacaacctcaaccaattgtcaaccagaaaatgtttaaatttacctatagcctggaagtccccactttgagttgtcccgcctttctaaaccaaaccaatgcatttcttaaatgtatttgattgatgtctcatgccttcctaaaatacataaaaccaagctgtaccccaaccaccttgggcacatgttctcaggacctcccgagggctgtgtcatgggccatggtcactcatatttggctcagcataaatctcctcatattttacagtttgactctttttgtcgacaatcatctggcacccacacatggggcctcagagaagactcagggtcacactatacatttaaaaatggttaagatgaccaggcacggtggctcacacctgtaatcccagcactttgggaggtgaggtgggtggatcactcgaggtcaggagttcgagaccagcctgggcaacatggtgaaaccccatctctattaaaaatacaaaagttagccaggcatgatggtgcatgcctataatcccagctactcaggaggctgagacaggagaatcacttgaacccagttggcagaggttgcagtgagccactgtactccagcctggaagacagagcaagactctgtcgcaaaataaaaaaagaaaaaaaaagatggttaagatgatatattgtgttatgcgtttttaacacaataaaaaataaattattaattgaaaacaatgcaaatatccatcagcagggaattggttatgctagagctatacaataaagtagctatcacaaatgataatactggtatctattcagccacaaccatagcccactgttgcaagttttttcaatttaaaaaaagcaaagcattatatcattaaaacatgtgtccatacctgtaactaaagacagagatatgtgtaaacagtggcatctcttggtaatagaattgcagatgacctttactttcttttttacattttcccgtgtggactaagtattacgtacatggcaaaagatggcttacaagaggaagtgactgccaccattggctccagaatcctgggatggaattttgtttccctcatcattatgtgtctggcacacgttgaaggattaataaaaatttgaaaggcaagatgaatagtggttaagagttcaggaattagacaggcctggatatgaatctcaactcaaatttatttaataggggcctcagaccttaaagctcttttttttttttttgtggtttgtttgagacagagtctcctgtgttgccccaggctggagtgcagtggctcaatcacagctcattgcagctttgacctcctgggccccagcgattccctcacctcagcctcctgtgtagctggaccacagttgtgcaccactacgcccagctaatttttttattttttgtagagactgaaatttcctatgttgcccaggctggtctagaactgctagactcaagtgattctcttgccttgacatcttaaagtgctgggattacaggtatgagccaccaggtcagacctctacaagtcttatttaccttcattgagcctcactttcttcaaatataaaaatgtcaagaagacttacagtttgtcataaggaaaatgtacttatcacacataacatcatttctggctcagacgaaactcaataaaatgatggccatcattactatttagtgactagatttacactggaagaactcctgacacaaacaaataaaaaaaaaaactaagcatctacagtagactgcattgctaaattatcactgaatatcctaattgcattaaaaagcaagagacaacactttgcctggtagatctacaaaaatgtcttgctgcaaggtatggttacattcctatatctagcaggattacactataaaatttaccatcttactttgtatacaaacatcactcgttagtattggacacagattagtgctttagtaaaaacaatgcaaagaggaaaacgtgcttattttaatccaaaggtagaatgtaaagaagggaccaaataaacatacaaaatgtgactaaagaagacttgacttagagattgaaacagtaagtgacattacaattttgtttagcctctctcttcctcacaacttttggacaaggagcctgtctttttaggcactgctctacccaaagtctggtatagtacccaatacagtgttaagcgctcataccataaatacaacaggatttataagagaaaatctcagtaaaatcatggagtaaactgaattagaatttatctgagaaagtctcagtcaaaataataaagcaaagagtttaagaataaagggcacacgcatagggagggaaaaacccttttctgtaacttgtatcttctttattcaatcagttttcctgggtaccttaaatggaatgtccaaaagtatacatacagtcgcccttgaactctgaaggaggcataaatcagggccttacgtgctaagattattaggctgtgggctccatgtggccgatgaataaaggcatctttttagtgatgcctttattcatcggtgtattatagttggcaccctgtagtcacacgttttttgtttttgtttttgttttgagacggagtctcgctctgtcacccgaggctggagtgcagtggcgcgatctcgggtcactgtaaccacttccgaagttgaagcgattctcctgcctcagcctcccgtgtagctgggactacagatcctacagatctctgccaccacgtccggctaatgtgtgtgtgtgagtttttagcagacacaagatttcaccatgttgcccaggctggtctcgaactcctgacctcaagtaatcctcccgcctcggcctcccaaagtgctaggattacaggtctgagccaccgcgcctgtctgccactcgtttaataaatggtcgttactcaaagagtggtgatggggccactcttgattatcaatccttcaaacagaaaagcccttttctgtgactcttttccttccaagctgactttagaagtgtgtttgtggccgggcgcggtggctcacgcctgtaatcccagcactttgggaggccaaggtgggcggatcacgaggtcaggagatcgagaccatcctggccaacatggtgaaaccccgtctctactaaaaatacaaaaaattagctgggctgagtggcgcgcgcctgtaatcccagctactccggaggctgagacaggagaatggcgtgaatcagtgagccaagatcccaccactgcactccagcctggggacagagcaagactccgtctcaaaaaaaaaaaaaaaaagtgtgtctgtaaatgtagttcagaacttcggagccctgtctttacagttcaaactgaccacgcgaagactaaaggcagtagaggtactttctacaaatttagccgtgcaatctaatagcgagcaggccgagacgcccgcgattgaaggccggggtggagaaagtaataagggccctggaaattacccccatcccatgtcacccactctttcttaaaatgccattaaattccgttcaactttttatctcccatgcaagaaactagcgacttgccagccacgccacttccagccagtcacacctggcgtattcgccgcagaatctccaactcccgccacaggtttgggacgtgtccgcccctaagcggaagtgacgttcaacgggacaacgtgaaagtagatgagtttaaatacgtactaataatttaaaacccctatggtattttgaggaaactcttccggctacccttcttccatcacttctctcccgttagggttgcgaaaagggctctgtacagcctcgcgacaactcgttctccgccctaatttcaagtcattcaaaactctgtcccttttcattggctgaagcggcggcatgggtacctctcaggaactacaattccagccaagcaccgcgacaagtgaacggaggagaagttatgagtaggggaaaagcatgttgggaatcgtagtccgctccaggccgaaaagagcaatcaccccgccctccgccactgaagctggagaaaccaggtgttcgtttcagaacccgttagcgctaaggggaggagccaaccccttaagcagcatgcctcacttcgccccacatggaggataattttcctttacccctaaaaagcactataaatacccactgaggagatctggttgtcttttaaatacctcgagtcagtaaaaactcacgaaactccgcacctcaggctccaactcgtgggaaaaggtagctcttttacaagtgggcaaaatggctgtcctcctagttttaccattgg

SEQ ID NO: 1103 - DNA, 17159 bp, Homo sapiens
aagtatattagtgctaatttccctccgtttgtcctagcttttctcttctgtcaaccccacacgcctttggcacaatgaagtgggtaacctttatttcccttctttttctctttagctcggcttattccaggggtgtgtttcgtcgagatgcacgtaagaaatccatttttctattgttcaacttttattctattttcccagtaaaataaagttttagtaaactctgcatctttaaagaattattttggcatttatttctaaaatggcatagtattttgtatttgtgaagtcttacaaggttatcttattaataaaattcaaacatcctaggtaaaaaaaaaaaaaggtcagaattgtttagtgactgtaattttcttttgcgcactaaggaaagtgcaaagtaacttagagtgactgaaacttcacagaatagggttgaagattgaattcataactatcccaaagacctatccattgcactatgctttatttaaaaaccacaaaacctgtgctgttgatctcataaatagaacttgtatttatatttattttcattttagtctgtcttcttggttgctgttgatagacactaaaagagtattagatattatctaagtttgaatataaggctataaatatttaataatttttaaaatagtattcttggtaattgaattattcttctgtttaaaggcagaagaaataattgaacatcatcctgagtttttctgtaggaatcagagcccaatattttgaaacaaatgcataatctaagtcaaatggaaagaaatataaaaagtaacattattacttcttgttttcttcagtatttaacaatccttttttttcttcccttgcccagacaagagtgaggttgctcatcggtttaaagatttgggagaagaaaatttcaaagccttgtaagttaaaatattgatgaatcaaatttaatgtttctaatagtgttgtttattattctaaagtgcttatatttccttgtcatcagggttcagattctaaaacagtgctgcctcgtagagttttctgcgttgaggaagatattctgtatctgggctatccaataaggtagtcactggtcacatggctattgagtacttcaaatatgacaagtgcaactgagaaacaaaaacttaaattgtatttaattgtagttaatttgaatgtatatagtcacatgtggctaatggctactgtattggacagtacagctctggaacttgcttggtggaaaggactttaatataggtttcctttggtggcttacccactaaatcttctttacatagcaagcattcctgtgcttagttgggaatatttaatttttttttttttttaagacagggtctcgctctgtcgcccaggctggagtgcagtggcgcaatctcggctcactgcaaactccgcctcccgggttcacgccattctcctgcctcagcctcccgagtagctgggactacaggcgcccgccatcacgcccggctaatcttttgtatttttagtagagatggggtttcaccgtgtgccaggatggtctcaatctcctgacatcgtgatctgcccacctcggcctcccaaagtgctgggattacaggagtgagccaccgcgcccggcctatttaaatgttttttaatctagtaaaaaatgagaaaattgtttttttaaaagtctacctaatcctacaggctaattaaagacgtgtgtggggatcaggtgcggtggttcacacctgtaatcccagcactttggaaggctgatgcaggaggattgcttgagcccaggagttcaagaccagcctgggcaagtctctttaaaaaaaacaaaacaaacaaacaaaaaaattaggcatggtggcacatgcctgtagtcctagctacttaggaggctgacgtaggaggatcgtttggacctgagaggtcaaggctacagtgagccatgattgtgccactgcactccagcctgggtgacagagtgagactctgtctcaaaaaagaaaaaggaaatctgtggggtttgttttagttttaagtaattctaaggactttaaaaatgcctagtcttgacaattagatctatttggcatacaatttgcttgcttaatctatgtgtgtgcatagatctactgacacacgcatacatataaacattagggaactaccattctctttgcgtaggaagccacatatgcctatctaggcctcagatcatacctgatatgaataggctttctggataatggtgaagaagatgtataaaagatagaacctatacccatacatgatttgttctctagcgtagcaacctgttacatattaaagttttattatactacatttttctacatcctttgtttcagggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttgtaagtacattctaattgtggagattctttcttctgtttgaagtaatcccaagcatttcaaaggaattttttttaagttttctcaattattattaagtgtcctgatttgtaagaaacactaaaaagttgctcatagactgataagccattgtttcttttgtgatagagatgctttagctatgtccacagttttaaaatcatttctttattgagaccaaacacaacagtcatggtgtatttaaatggcaatttgtcatttataaacacctctttttaaaatttgaggtttggtttctttttgtagaggctaatagggatatgatagcatgtatttatttatttatttatcttattttattatagtaagaacccttaacatgagatctaccctgttatatttttaagtgtacaatccattattgttaactacgggtacactgttgtatagcttactcatcttgctgtattaaaactttgtgcccattgattagtaacccctcgtttcgtcctcccccagccactggcaaccagcattatactctttgattctatgagtttgactactttagctaccttatataagtggtattatgtactgtttatctttttatgactgacttatttcccttagcatagtgcattcaaagtccaaccatgttgttgcctattgcagaatttccttcttttcaaggctgaataatattccagtgcatgtgtgtaccacattttctttatccattaatttgttgattgatagacatttaggttggttttctacatcttgactatcatgaatagtgttgcaatgaacacaggagagctactatctcttagagatgatatcatggtttttatcatcagaaaacacccactgatttctatgctaattttgttacctgggtggaataatagtacagctatatattcctcattttagatatctttgtatttctacatacaataaaaaagcagagtacttagtcatgttgaagaactttaaacttttagtatttccagatcaatcttcaaaacaaggacaggtttatctttctctcaccactcaatctatatatacctcttgtgggcaaggccagtttttatcactggagcctttcccctttttattatgtacctctccctcacagcagagtcaggactttaactttacacaatactatggctctacatatgaaatcttaaaaatacataaaaattaataaattctgtctagagtagtatattttccctggggttacagttactttcataataaaaattagagataaggaaaggactcatttattggaaagtgattttaggtaacatttctggaagaaaaatgtctatatcttaatagtcacttaatatatgatggattgtgttactcctcagttttcaatggcatatactaaaacatggccctctaaaaagggggcaaatgaaatgagaaactctctgaatgtttttctcccctaggtgaattcacctgctgcttagaagcttattttctcttgatttctgttataatgattgctcttaccctttagttttaagtttcaaaataggagtcatataactttccttaaagctattgactgtctttttgtcctgttttattcaccatgagttatagtgtgacagttaattcttatgaaaattatatagagatggttaaatcatcagaaactgtaaacctcgattgggaggggaagcggatttttaaatgatttcctgaccaagcttaaccagtatattaaatcctttgtactgttctttggctataaagaaaaaaggtactgtccagcaactgaaacctgctttcttccatttagcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaagtaagtaatcagatgtttatagttcaaaattaaaaagcatggagtaactccataggccaacactctataaaaattaccataacaaaaatattttcaacattaagacttggaagttttgttatgatgattttttaaagaagtagtatttgataccacaaaattctacacagcaaaaaatatgatcaaagatattttgaagtttattgaaacaggatacaatctttctgaaaaatttaagatagacaaattatttaatgtattacgaagatatgtatatatggttgttataattgatttcgttttagtcagcaacattatattgccaaaatttaaccatttatgcacacacacacacacacacacacacttaacccttttttccacatacttaaagaatgacagagacaagaccatcatgtgcaaattgagcttaattggttaattagatatctttggaatttggaggttctggggagaatgtcgattacaattatttctgtaatattgtctgctatagaaaagtgactgtttttctttttcaaaatttagatacttatatgaaattgccagaagacatccttacttttatgccccggaactccttttctttgctaaaaggtataaagctgcttttacagaatgttgccaagctgctgataaagctgcctgcctgttgccaaaggtattatgcaaaagaatagaaaaaaagagttcattatccaacctgattttgtccattttgtggctagatttagggaacctgagtgtctgatacaaactttccgacatggtcaaaaaagccttccttttatctgtcttgaaaatctttcatctttgaaggcctacactctcgtttcttcttttaagatttgccaatgatgatctgtcagaggtaatcactgtgcatgtgtttaaagatttcaccactttttatggtggtgatcactatagtgaaatactgaaacttgtttgtcaaattgcacagcaaggggccacagttcttgtttatcttttcatgataatttttagtagggagggaattcaaagtagagaattttactgcatctagatgcctgagttcatgcattcattccataaatatatattatggaatgctttattttcttttctgaggagtttactgatgttggtggaggagagactgaaatgaattatacacaaaatttaaaaattagcaaaattgcagcccctgggatattagcgtactctttctctgacttttctcccacttttaaggctctttttcctggcaatgtttccagttggtttctaactacatagggaattccgctgtgaccagaatgatcgaatgatctttccttttcttagagagcaaaatcattattcgctaaagggagtacttgggaatttaggcataaattatgccttcaaaatttaatttggcacagtctcatctgagcttatggaggggtgtttcatgtagaatttttcttctaattttcatcaaattattcctttttgtagctcgatgaacttcgggatgaagggaaggcttcgtctgccaaacagagactcaagtgtgccagtctccaaaaatttggagaaagagctttcaaagcatggtaaatacttttaaacatagttggcatctttataacgatgtaaatgataatgcttcagtgacaaattgtacatttttatgtattttgcaaagtgctgtcaaatacatttctttggttgtctaacaggtagaactctaatagaggtaaaaatcagaatatcaatgacaatttgacattatttttaatcttttcttttctaaatagttgaataatttagaggacgctgtcctttttgtcctaaaaaaagggacagatatttaagttctatttatttataaaatcttggactcttattctaatggttcattatttttatagagctgtaggcatggttctttatttaattttttaaagttatttttaatttttgtggatacagagtaggtatacatatttacggggtatatgagatattttgatataagtatacaacatatataatccctttatttaattttatcttccccccaatgatctaaaactatttgcttgtccttttatgtcttatagttaaattcagtcaccaactaagttgaagttacttcttatttttgcatagctccagctctgatcttcatctcatgtttttgcctgagcctctgttttcatattacttagttggttctgggagcatactttaatagccgagtcaagaaaaatactagctgccccgtcacccacactcctcacctgctagtcaacagcaaatcaacacaacaggaaataaaatgaaaataatagacattatgcatgctctctagaaactgtcaattgaactgtatttgctcatcattcctaccatctacaccaccaaaatcaaccaaatttatgaaaaaaaacagccccaacataaaattatacacagataaacaggctatgattggttttgggaaagaagtcacctttacctgatttaggcaactgtgaaatgactagagaatgaagaaaattagacgtttacatcttgtcatagagtttgaagatagtgctggatctttctttttataagtaagatcaataaaaactccctcattctgtagaagttatgatttcttttctaagagacctttagaagtcagaaaaaatgtgtttcaattgagaaaaaagataactggagtttgtgtagtacttcccagattataaaatgcttttgtatgtattatctaatttaatcctcaaaacttcttcaatttagcatgttgtcatgacactgcagaggctgaagctcagagaggctgagccctctgctaacaagtcctactgctaacaagtgataaagccagagctggaagtcacatctggactccaaacctgatgcttctcagcctgttgccccttttagagttcctttttaatttctgcttttatgacttgctagatttctacctaccacacacactcttaaatggataattctgccctaaggataagtgattaccatttggttcagaactagaactaatgaattttaaaaattatttctgtatgtccattttgaattttcttatgagaaatagtatttgcctagtgttttcatataaaatatcgcatgataataccattttgattggcgattttctttttagggcagtagctcgcctgagccagagatttcccaaagctgagtttgcagaagtttccaagttagtgacagatcttaccaaagtccacacggaatgctgccatggagatctgcttgaatgtgctgatgacagggtaaagagtcgtcgatatgctttttggtagcttgcatgctcaagttggtagaatggatgcgtttggtatcattggtgatagctgacagtgggttgagattgtcttctgtgctttcgtctgtcctatcttcaatctttccctgcctatggtggtggtacctttctgtttttaacctggctataaattaccagataaacccattcactgatttgtaactcctttcagtcatgctctaactgtaaatgaaggcttaaactgaagtagaacagttacaaggttttacttggcagaacatcttgcaaggtagatgtctaagaagatttttttttctttttttaagacagagtttcgctcttgtttcccaggctggggtgcaatggtgtgatcttggctcagcgcaacctctgcctcctgggttcaagtgattctcatgcctcagcctcccaagtagctgggattacaggcatgcgccaccacacctggctaattttgtatttttagtagaggcggggtttcaccatattgtccagactggtctcgaactcctgacctcaggtgatccacccgccttggcctcccaaagtgctgggattacaggcatgagccaccttgcccagcctaagaagattttttgagggaggtaggtggacttggagaaggtcactacttgaagagatttttggaaatgatgtatttttcttctctatattccttcccttaattaactctgtttgttagatgtgcaaatatttggaatgatatctcttttctcaaaacttataatattttctttctccctttcttcaagattaaacttatgggcaaatactagaatcctaatctctcatggcactttctggaaaatttaaggcggttattttatatatgtaagcagggcctatgactatgatcttgactcatttttcaaaaatcttctatattttatttagttatttggtttcaaaaggcctgcacttaattttgggggattatttggaaaaacagcattgagttttaatgaaaaaaacttaaatgccctaacagtagaaacataaaattaataaataactgagctgagcacctgctactgattagtctattttaattaagtgggaatgtttttgtagtcctatctacatctccaggtttaggagcaaacagagtatgttcatagaaggaatatgtgtatggtcttagaatacaatgaatatgttctgccaacttaataaaggtctgaggagaaagtgtagcaatgtcaattcgtgttgaacaatttccaccaacttacttataggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtaagtagataagaaattattcttttatagctttggcatgacctcacaacttaggaggatagcctaggcttttctgtggagttgctacaatttccctgctgcccagaatgtttcttcatccttccctttcccaggctttaacaatttttgaaatagttaattagttgaatacattgtcataaaataatacatgttcatggcaaagctcaacattccttactccttaggggtatttctgaaaatacgtctagaaacattttgtgtatatataaattatgtatacttcagtcattcattccaagtgtatttcttgaacatctataatatatgtgtgtgactatgtattgcctgtctatctaactaatctaatctaatctagtctatctatctaatctatgcaatgatagcaaagaagtataaaaagaaatatagagtctgacaccaggtgctttatatttggtgaaaagaccagaagttcagtataatggcaatatggtaggcaactcaattacaaaataaatgtttacatattgtcagaagttgtggtgataaactgcatttttgttgttggattatgataatgcactaaataatatttcctaaaattatgtaccctacaagatttcactcatacagagaagaaagagaatattttaagaacatatctctgcccatctatttatcagaatccttttgagatgtagtttaaatcaaacaaaatgttaataaaaataacaagtatcattcatcaaagacttcatatgtgccaagcagtgtgtgctttgtgtagattatgtcatatagttctcataatccaccttccgagacagatactatttattttttgagacagagttttactcttgttgcccaggctggagtgcaatggtgccatctcggctcaccacaacctccgcctcccaggttcaagcgattctcctgcctcagcctcctgggattacaggcatgcaccaccatgcctggctaattttgtatttttagtagagatggggtttcaccatgttggtcagactggtctcaaactcctgacctctggtgatatgcctgcctcagcctcctaaagtgctgggattacaggcatgagccactgtgcccagccgacagatactattattatttccattctaccgagaaggagactaaggctctgatcatttaaataagttgcctaaggtgatgcagtgatataagtagcagagctaggaattgagccttggtaactttaactctggaccccaagtccttagctactaagctttactgcatggggtttagtcaaattaagacttttggaatatgagttacttttgagattagctttgtgatattttttgtgctcatttgtccaacaaagtctattttattttcatcttaattaggtttttgtatgaatatgcaagaaggcatcctgattactctgtcgtgctgctgctgagacttgccaagacatatgaaaccactctagagaagtgctgtgccgctgcagatcctcatgaatgctatgccaaagtggtaggtttattgttggaaaaaaatgtagttctttgactgatgattccaataatgagaaagaaaaataatgcaagaatgtaaaatgatatacagtgcaatttagatcttttcttgagatggtttcaattctggaatcttaaacatgaaagaaaaagtagccttagaatgattaacaaaatttagactagttagaatagaaagatctgaatagagcaatctctaaaaaattttgatctttttttctctttttcacaatcctgagaacaaaaaaaaattaaatttaaatgttaattagaagatatttaacttagatgtaaagtgagttaacctgattccaggattaatcaagtactagaattagtatcttatggcaaattatagaacctatccctttagaatattttcaaatctttttgaggatgtttaggaatagttttacaagaaattaagttaggagaggaaatctgttctggaggatttttagggttcccactagcatatgtaatggtttctgaactattcagaatcagagaaaactcatttttcctgctttcaagaagctactgtatgccaggcaccatgcacaaacaatgaccaacgtaaaatctctcattttggagagcctggaatctaactggaaaggtgaactaataataataatatgtacaatcatagccatcatttattaaacttttattatatgcaaggcactgtttaatttcattagcttacctggtttacagagcagctctatgagatgagtgccatctttgcccctattttagggataaggattctgaaatgtggagatggtaagtaaaattgcacaactgaagaatgagttacatgacttggctcaaatactggtcattgaactccagagcctgaatattcttaaccacttacatgatgcaagctcaccaaataaatagttcgaatgtattgtgacagagcggcattgatattcatctattcatgtggctttgagtaggaagaagaaaggatatcattctgaccagaggggtgaaaaacaacctgcatctgatcctgaggcataatactattaacacaattcttttatgtttcagttcgatgaatttaaacctcttgtggaagagcctcagaatttaatcaaacaaaattgtgagctttttgagcagcttggagagtacaaattccagaatgcgtaagtaatttttattgactgattttttttatcaatttgtaattatttaagacttaatatatgagccacctagcatagaacttttaagaatgaaaatacattgcatatttctaatcactctttgtcaagaaagataggagaggagagataaaatagttgatggggtggagaggtctatatttgaatgtagtctaaaaattgttctcttaagattggaagtatgtaggctgggagggtaaataccaaatcttggtatatcagaactgagcatgtcccttgaaggttaagaaatagttaatgggcaaatagagcatggcaatattttgtagagcagcaagtagtaggccttgaatagatgtcgctcaaaaagtaatatgtaagctgaacacaaaaatgtaacaaatgaatttagatacatatttgaatattaaattcaggttgtttgggagatgcacctagtctttgatggttaaacctttccctccatagaagagacagagacagaatggcttgctggactaatgtcccaattcaatagagtcttatctatgaaggttaaaaacaagaagagacatattatacagtagatatttattgtgtggctcatacacatggtgctcttctgattatggattttagagataataacagtgaacaagacatagtttctttcctcgagtagattaaagtcatacattgacttttaatggtgactggcattcttaatacatgattattatatattaggtaccatgtcagattaattataatactttactacttttaatttaacccttgaactatccctattgagtcagatatatttccttccattttctacttgtatctttcaagtttagcatatgctgatacatatgaagctctctccaggttttattgaaagaagaaattaataaatttattaatgtcactgaattaggcaactcactttcccaagattatgcaagtggtacaggtggaactcaaagccaagtttaactagttgttcaggagaatgttttctaccctccactaacccactactctgcagatggagataatatgatgaatggaacatagcaacatcttagttgattccggccaagtgttctctgttttatctactatgttagacagtttcttgccttgctgaaaacacatgacttctttttttcaggctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatgtgagtctttaaaaaaatataataaattaataatgaaaaaattttacctttagatattgataatgctagctttcataagcagaaggaagtaatgtgtgtgtgtgcatgtttgtgtgcatgtgtgtgtgcatgcacgtgtgtgtatgtgtgatattggcagtcaaggccccgaggatgataattttttttttttttttgagacggagtctcgctttgttgtccaggctggagtgcagtggtgccatctcggctcactgcaacctccgcctcccaggttcaagccattctcctgcctcagcctcccaagtagctgggactacaggtgcatgccaccatgcctggctaattttttgtatttttagtagaaaattttcagcttcacctcttttgaatttctgctctcctgcctgttctttagctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaacgtgaggagtatttcattactgcatgtgtttgtagtcttgatagcaagaactgtcaattcaagctagcaactttttcctgaagtagtgattatatttcttagaggaaagtattggagtgttgcccttattatgctgataagagtacccagaataaaatgaataactttttaaagacaaaatcctctgttataatattgctaaaattattcagagtaatattgtggattaaagccacaatagaataacatgttaggccatattcagtagaaaaagatgaacaattaactgataaatttgtgcacatggcaaattagttaatgggaaccataggagaatttatttctagatgtaaataattattttaagtttgccctatggtggccccacacatgagacaaacccccaagatgtgacttttgagaatgagacttggataaaaaacatgtagaaatgcaagccctgaagctcaactccctattgctatcacaggggttataattgcataaaatttagctatagaaagttgctgtcatctcttgtgggctgtaatcatcgtctaggcttaagagtaatattgcaaaacctgtcatgcccacacaaatctctccctggcattgttgtctttgcagatgtcagtgaaagagaaccagcagctcccatgagtttggatagccttattttctatagcctccccactattagctttgaagggagcaaagtttaagaaccaaatataaagtttctcatctttatagatgagaaaaattttaaataaagtccaagataattaaatttttaaggatcatttttagctctttaatagcaataaaactcaatatgacataatatggcacttccaaaatctgaataatatataattgcaatgacatacttcttttcagagatttactgaaaagaaatttgttgacactacataacgtgatgagtggtttatactgattgtttcagttggtcttcccaccaactccatgaaagtggattttattatcctcatcatgcagatgagaatattgagacttatagcggtatgcctgagccccaaagtactcagagttgcctggctccaagatttataatcttaaatgatgggactaccatccttactctctccatttttctatacgtgagtaatgttttttctgttttttttttttctttttccattcaaactcagtgcacttgttgagctcgtgaaacacaagcccaaggcaacaaaagagcaactgaaagctgttatggatgatttcgcagcttttgtagagaagtgctgcaaggctgacgataaggagacctgctttgccgaggaggtactacagttctcttcattttaatatgtccagtattcatttttgcatgtttggttaggctagggcttagggatttatatatcaaaggaggctttgtacatgtgggacagggatcttattttacaaacaattgtcttacaaaatgaataaaacagcactttgtttttatctcctgctctattgtgccatactgttaaatgtttataatgcctgttctgtttccaaatttgtgatgcttatgaatattaataggaatatttgtaaggcctgaaatattttgatcatgaaatcaaaacattaatttatttaaacatttacttgaaatgtggtggtttgtgatttagttgattttataggctagtgggagaatttacattcaaatgtctaaatcacttaaaattgccctttatggcctgacagtaacttttttttattcatttggggacaactatgtccgtgagcttccgtccagagattatagtagtaaattgtaattaaaggatatgatgcacgtgaaatcactttgcaatcatcaatagcttcataaatgttaattttgtatcctaatagtaatgctaatattttcctaacatctgtcatgtctttgtgttcagggtaaaaaacttgttgctgcaagtcaagctgccttaggcttataacatcacatttaaaagcatctcaggtaactatattttgaattttttaaaaaagtaactataatagttattattaaaatagcaaagattgaccatttccaagagccatatagaccagcaccgaccactattctaaactatttatgtatgtaaatattagcttttaaaattctcaaaatagttgctgagttgggaaccactattatttctattttgtagatgagaaaatgaagataaacatcaaagcatagattaagtaattttccaaagggtcaaaattcaaaattgaaaccaaagtttcagtgttgcccattgtcctgttctgacttatatgatgcggtacacagagccatccaagtaagtgatggctcagcagtggaatactctgggaattaggctgaaccacatgaaagagtgctttatagggcaaaaacagttgaatatcagtgatttcacatggttcaacctaatagttcaactcatcctttccattggagaatatgatggatctaccttctgtgaactttatagtgaagaatctgctattacatttccaatttgtcaacatgctgagctttaataggacttatcttcttatgacaacatttattggtgtgtccccttgcctagcccaacagaagaattcagcagccgtaagtctaggacaggcttaaattgttttcactggtgtaaattgcagaaagatgatctaagtaatttggcatttattttaataggtttgaaaaacacatgccattttacaaataagacttatatttgtccttttgtttttcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaa

SEQ ID NO: 1104 - DNA, 279569 bp, Homo sapiens
atacttctttgagtcaataattttattactattatttttcacactgaggagacttagttacataaagtgatattctatgaattgattatcagtagtagaagcacaaaggtatggacagtgaaacaagaagaaacaccctttatcagaatgaagtccatgtgacagaagtacatacttcagacagcctatgtacaaataagtagagcttcctgtctatgtacagacatattcacagagaataaactgacatagtatcaccatgtatctcatcatccagtgaaaattacgcataataaacacaacacatacaaaatgacagaagtaatttggaagtgcatccactggatttttgtagggatgaggataggggttacaatgctcctttaaaacggaggcgaacaaaggaagcatgagaccacgtctatcctaaaaaagatcctttacaaaaatggcattctgatatttttaacataacctgtctaaaagacagtttatatgttatagagcaaatgtctatgttggcgtcaacgttgacaacattttctttgttttaaccgtatctgaagaacaaaagtataatttctcttgcttttagtgctagcagcaacttcactgaatcaggaaggtagcttttgctattcttagctttgatggctttttaagtatgtggattgcttgatggtggaagctgttgcttccggagttttttgacttgagcagaagaaatatcaaggctagatgcagggtatatatgtgtactttgtgttcagggttcaatagcgcaattcagtaactgaggctccctcttccgaatagagtctcagccctttagagaaactcttcagaccacaaaacagcctctaacagaggaatatcactggcccttggttcagataccctttctttagggcaatttggccacttaagcataaaattgatggggttgtccagtttagtacccatgtttactctatatggacaatttaggtacccagttctggtggatttctagactattaagtgctttttagtaattacttttactcaaattacataaaagggctgggtatggtggctcattcctttaatcccagcactttgggaggccaaagcaggaggatctcttgagcccaggagtttgagaccagcctgggtaacatagtgagactccatctcttaacaacaacaacaaaattagccaggcatggtggcatgtgcctgaggtcccagctactcaagaggctgaagtgggaggatcgcttgagtccaggtgtttgaggctacactgagctatgattgcaccactgcactctagcctgggtgacagagcaagaccctgtctgttaaaaaaaaaattatataaaaatttgtgatgaagttgaaacattaaagtttttagttgtggggacatctttatatatgtgtgtgtaaacagtgtaccatactaggttagaaattgtgtattttagcggagaggaggaaaataaccaccaaagcattatgaaatctgctgctttacatgtcctcccaaggaaggttagtaatttaggcataaggaattattgataaattgtatacctctatttcccatttttataagggaacttcttagacccatcctatatttatataaaagctcaaacacatcctacatttcccaggtatatgtttgctaattatctatttcattttccatatgggtgaactttgctttatataacaaaatggattcctgaaaaaaatctacaattttaaaataatttccatgtagtattagaacttgctaaagaaactgtaataagctattttgaaaacgaagactgcttttgtgaaatgaataatttctttgattttcaaacagttttattaaagcacacatctaaaatgtataagtagattaggattgcctagaacaataattgtagttaataaaaaatagaacagataaactccaatttacaataaacaatacaaaacaggaatgactcatggactgcttattgattgactatattcagaagccctgaatatatgtattattggtattttatggctttaattaagacagttgtctcttatgaagtactataaagtgcaatattaaaaaattaaaaaacccaaaaggcatccattgtccttcagttttattctgataagaattggggatttgtttaattaaatggcaagaagttatctacccttaatttatgcatgtaatttcatccttaaaataattttattcaggatttcagactttttttacttttctgttttttatgacatgattttaaaaattagtattttcttttggttagctgagtattttggagaactgttagtctccaaggccttagttacttatggatccattatgaaggaatatgcaacccaatatgtaagaatgcagaaacaaattcccatccttttggtgaaccctggcccatgagatcaatcagtagctttacaaatcctatccaacctaccacacaaaaggatataaacacactgcagtactggttaataagtggagatccaatcatttatcccagtttcatatttaaaataaaaatattgattcctcttgataaattagtgggtaagtacaggcccagagttttggagtaatctaaagtggtgtctccccaattttgagttctttgtgagtctgagattatgacctaatgaccttaaaagcagtttgtgaccttgacttcaccagagcttcatggtcatgctgcacccagtatagttcaacactgttcagacagtgattatcattagtcataaggttccatcatttaagaacaatataaagaacttaaaaaggcttagtagagaggaactataaaaattattaagagggttaaagactcaaataaaaatctaaagataattttaattgaaaataggtaaagagtcacatagcggtaacttccaactatggggcaaagagtgaagagtgcccagatgcagttactttttgccaaaaaaaaaaaaaaaaaaaaaaaaagttaagtcattaagtggatgggtttgggttaacttggagggaggcttttcttgatgctgatggttgttaatcattgagctgggtcacaccagcatctatgctgggatctcccccgtaagaggactgtcctttggattagcgtgataggctagacaaaccctcttaatggaattaaatctttggtggaagcctaggcaaactccatggcattctttcagacttagatatttgtctgtttttaaagattttattaggttttccagtctgtcaatgaatgatctggtagaagtgctttggcttagataatatggtgctctacacagtccctcactgttcgtacgctaatttgaaaacagttgcctagcctgtcgtaattgcagggtcatttttgcctctcgaatgctgcctgacttgtggatttgcttgtcctttgtagctgcttcttactctttcttaagaaatctgtccctagccatattaagggcctctgtggagtttgggtggttctgagcaaggctggtgccccatgtgtgaggaaggcatgcaaaatgccagtgtgtacattagctggggggagtcattgtggaaaacagattccttccagagcaaacatgagtgtgcctgtgatttctacagacgactacatgctccgggtgattacatgccacaacctgcgcaggtccaaagctcctggtgaaaaaggaatattgccatggtgtaatcataagtaatagagttgagctggctgtgagtagttcccttattgcttttcttgtttgctatatatttaaaaaatatgaagctctgagattaaaaatgaaacgcaaagacagaggcagaggcagagtcagggagctaacagtaaatagaaggtggaatagggcagggttacttttcttacccaaggtcttcctgagattattttttaaaaaaatctaaaactgtatatgggctcttgtaattggctaaacatagcctgatatttgttactgttttaaactacatagggatatatttccacgtgacacttgttttcttggaatcctaggaaattaatatctcctttcttccctttccttattattctattttttctcctacccctctcttaatgacaaggccttacctaataattgaagacagtattgttgagacaggtataggggttgaggaggtatcttttaaaaatattaagccggatcgttaaggaatatgtggcttagcaagagtgagcactgacttctatgcatgctttcaggagacagtagttttctccagaaatcaccctgagaacagcttcactttgtttcttctggaacacagctgccacctataatagggccacctacttaccagaaaaacaatctgtccaggtgcaaggaggcatagcatccacataatctcgcgtgtgtgtgggggtgtgggtgtgtgtttggtagatgtggggaggaaagcacactgccatgttctgaaatgcctgccatcagacccatgttagatagtccaacgcagtaatttctgcagagcatttaatgcaacttccatcttcttcagctctatctggccagccactctaccaggtgtcttttctttggtcaactttttgttaaagtggtctgggggtgggctccctttgtagctcatctcttctctcactgttccagaggcctttaaaagctatgtgcagtggtggggagtttgccaactctctccctgcccaggaatggatgtacattaacattgtcaaatgtctaatcagcgaggcagctgcgttttgctgaaagggctccaaaccacctgattcatgtcttccctataaaataaattatgatggcccttgtcaggtgacacctgttagaagccttacaaagcatttttcctgaatataaaacagtctccgcctctttttataatcttctgggcaaggctttaggacattctgctgcatctgccgagggtataaacaaccctatcccttagtccctgcatatatcattgctctgtcactgcctgactcagtttaggtcctgggaagctgcataaacaccatctgatcttcagcttcagttcatcaggatctggtcaggtgcagagggcagctggagttggcatgggcattctcagatgcaatttaggagtttctatttgggaattgtcagtttgagccaagctgctctgctgccttggaagtatgggggagggtaggcggtgacagcaagcaagacctgctcggtttgctgtgaataaatgaaatcatttgcgtgcaactcatttattttagattgattagtacaatgttggctcttgaattgttgatatcttttataccctgctccagagaagcaaagagagtatctgcagtctaaatttttgctttgtattttctgttgtgtattctttgcctctatatcagcattagggatatggctgaccgatttccttaaggctataaattgatattcttagggtgggaaaatatgggtacatatgtgtatatttgtaaatatatgtgcatggaacaaacaaccttatgaaatcaggaagaaatgttccctttggtttgtgtgcatgactttccttttccttgactttggcaaacttgatgctccctgctttagaatcctgaatgtgatagggtcagagggtgatgatgtaagtcatattatatgtgtacatatagatctggtataaagatatatatatatatatatatatgtatatatatatatatgtatatatttatatatgtatatacacaggcatgcaggaaacgagttagagatgacctgttttggaaaccacggtgtggaaagttcttataattatgccaatgatttgaatggtttaaagacccattgttgaactctgtacacatctctctgaatttaccctggctcaacacataaccacttacagacacagaaatgaagggaaagcaagggcaggctgtggaatcacttgtgtcccatccagtgagggagcagtgctgttgtaggtcaggctcagtgcacatgactgatgtgggaacggggcttggaaattttgtcttctcaaatgcaacttcacatgaaagaccacaacacttcctgtgaagtggagctccgagacaagcaaagggcaccatagctgctttgatcagccttcactgtaagctgggaataaatgggagggagtgaggaggcagagggaggatcaggaataagaagagggcggcatcaggtctccttcaacttctgttttacatggtctgtttgcagttgagtcagtcacctatttaaaccttatttcaaacaacgcaccagtcaataatataaaattcacacaataaccaacttggttgcccttcaagaaatacacagggaaaacaactggagtttttaaacgtaaagttcacttcctcattctttcactctctaaggaagcaggacaaattcttgccccagtacaaagtcctgaccttgatgaatgagattcattcccattaggtggcaggttccactcagcgcctctattggatggtgtttcaatgtcttggaaggcattgtcccacatctgaagaccccaatctgccgagttggagagacttgaaagccagcctccgactggcagccatcttgatttcttgttttcccagggggcctcgggtttgaagtgctttttacttctgggtgaagaggaatgatgggcatttcctgttattgccatgctctgtggggtgagctgaggttttctggaaggaatactgagcttgatctggggctgtcaggttacctttcctcttattctgctgtgagttctgcatcctgtcctcttatgttaagaggtatgtgctcacaacaaaatcatagcaggcgtcaatgacagaatagattggagataggaacacatatggtgaaatttcccatatgccatatgtaccaacttagacgtaggatgggtacagaataatgaaccatccttgattcaatttttcaactgattttaaggaaagcatgacttggagaaaagaaaagtgctctacatagttttccattgattcagtttgcctattttttcccccttgctggctttattttcgactgacatagatctgagaaaacacacaaggtgtcatacagaacttgggggcgtggaatattttaatttcatgcattcaatgtaatgttgagcaaaatcaagaaatcaaattgttggagtgaatagcttgaaaccagtataaggaagctgtcaaataccgtgtactctaaaacttagacagaatcccagataaggtcttgatggaagaagagacatagatgttacaagaactttaaccaaagcctggtcctggtaccactcgacctggcactcagaaaccttcctggggtgcactgagtgtgcaaatgcctttccaagcatcgctaagttgcctcaacccaagcagtgctgatcagagttaagttagtgctattgggaataatgatttcttcagacactaaagccctttatgactacactggaaaacgttttaaagaactatgcccttacatcccattaggtggcaaggcccactaagcacctttactggatgacttcttattgcacatctaggctctcttggcagcccttagcatcaaaatatatctacatgacaatcacagctaaacttacccctcttcttttgatgataatgggacatgcgctggaaaaatacaggttcagtttatatagtcttgctgtcctagaaaaagcactaatttggtttgtagtcatattttctacttgcatgctgggacaatataagaacaaaacaaaacaacccaaccctggttacctccccacttccccaaaccaagccacccagcctgggtttttacctctttctgtcctaagtaccctgagtttcttggtcagggtactctggtggaggtgggcagatagtctctctgtttggcttgtaggaatgttttggaaggctcaactcagggcccctacagaccttctccactaagccctcctccctgcaagctatttccctaaaccatctaccttactaggcaggatcacagcaagtccaaggtaggctgaaggtcacagcaatgctacctttgtcttgttggttccattagttcacctcttgtacttaagaggtaaagcccagactgcaagttgatgcccctcttcaaataagtactataaatatactagagctatccctgaaaagatgcatttgtacttttatatatatctgattttatatatatatatataatttttctttgtctttatttacaggtatgtactaatctataggtatgcaaggagaggtatagtacaggaacaggcaggatttgtgtgttcatgtgcgtatatttataatatgtgtatttatagatatatatagcctgtgtccttgtttgcatcgactgtacctccgaccagcgaggtgtacttgtcagtggtgaatagggagaagccctgtattgacggttctctttgtcttttacatgaagtcatttcagtaggcagggtggaagcagcctgtgaagtgaatgggcccagtgtgaatccatctctcctcaaattcaccaaggagggacacttggcacccagggctgtgtgccagctgcctcttctcaagaggtcaaggagcccagagcccagagtgtggagggaccattcatgctgctggtgcaagatatggcttttcctgctagatggagacggggcatgtaagaattctgtcttctaggagaacgctcaccaccaggaacacaaagtagaggccaaacatgatgaagcccaggattttgttcattcgccacttgcagagggcgatagagaggatgacgaagagcagcatgatgaagagaaggacgatggcacagaaaaggccattgctgctgacagccactggctggaatctgtgaatgacggtgtacaggagccagggcagtgggagcctgtgcagaagtgaagcagggcagaggggagtgggaagacaagggagtagtcagacacgttgaagaaggcaaatataacctattattaccttctcaggaactctaaactgaaaagggtgtcttgttaggttcactatgactcgggcatggttggcccaggaaaccactttataaggaaataagactttaaaaacctttatgtcctgactgaattcagaacagggagaacagttagacaacatcaaagacatgactgctgtgggtgatttctacatttgcgaatttgactggaaattattttgtttccttcctagttgagattaaaatgttgctttcagtcctaaaaaggtgaattccaggatttgcacagggtgaagggagcaggcaggtgcaaaaaaggcacagaaatgagtggtgaaaatgaggaaaaaattaaaaaatggagacaaagaatagcaatgacttaatagtctaaaggcaagtgaaattaaatgatggtggttgggggccacgatacaatatcacaggctgaagtttattctgggaaagatgttgacaattgtttgatgaaaaattggtctttctgaaagatttaaggaaggcagtatcttacatttgtgatgtgtgtgtttttcttaaaaaaaactttattatatatttttatacctgttttctcccttttcattcaccttttaaaatctgaggatctcttgtgtttcctatcgagagtggtgatcctgaaagacctcaggagagctagtttccactacaccacaagcattgactagaactctgggaaaggaagatggctggaagtgcaaggctcagggaacatgggcatttccaagtggctggtgataggcatctggctctacccatcagcctaatgacagcatggtggctaaggagatacctgcttggctagctgagctttctgaatgacaaaagctaagggaggttcagttttggcctagactcagggtgtgggaagaggaggtactcttttgaaacattacattcttcaaaggaagagagaaatgatgagggtgaaaggggcagtgagtttactcatctgcctcctgtgctggagagacggcattggaaggcagagcccgtgcattgtggatctttgaaattccaggcctggtacatgcagcccctaactgggtgcatatgttaacctgggccaagctgaagtgattgatgtgactgccttgtggggatcaataccggcactttgcccagtagagtctggccaggaggtgcttctttctgtgaacttgttggggaggggttccaagcttgggaacaaggggtaattccagttcttagcaggagggggcagccttggcatcctggggtcagcaatgaaaagtcagaaaatggaaggggagtgcctgagagtgggggtgatggcaaactgagagccattgacagggacttggcctgggaaactcttttcccatcccttgtgaagaaagaccaaaacccattttattcttattaaaacacacacacacacacacacacacacacacacacacacacacacacactctcacacttctagtgaagttgagtttaatcgcactataaatggcttgcaaaaacctttcgggggaaaatgacacttttcatgccttttggtctattaattctatcgtcaagaattaagtataaaaataactgaaaatgcagattaaactttactcagaaaatgatcatttcagtgttattttgaataataaaaagctgagtatctctaataatctctaataacagggaactagttaaatagtaaataagtaaatgtaatgttatatagctgtttaaaaaatcacaagcttagaatgctacaggaaaatagccataatataattctaagctaaagatgaaagatgcatacatacacacaaatagcaatgtaatttcaatcatgtgaaatacacaagaatttcaaaaggttggtgagttattgatctttaagctttatttttcttttctttctttttcttttcttttcttttttttttttttgagatggagtcttgctctgtcgcccaggctggagtgcagtggcgtgatcttggttcactgcaacctccacctcctgggttcaagcgattctcctgcctcagcttcccgagtagctgggactgcaggcgcacgccaccattcgtagataatttttgtattttcagtagagacaggtttgcaccatctgggccaggatggtctcaatctcttgaccttgtgatccgcccacctcagcctcccaaagtgctgggattacaggtgtgagccactgcgccctggagccttatttttattttctaaatctgtgagtatatgttaattttagaagcataaagaaaatgctggcaaagctatgaagaaagtttcacacttaatatattgcaatgacatcactcagtatattgtcaaaaatgttgtcagctggtataaattcttgggaaagaactttttggaaaagaaatgtacaagacatgtcaatacccattaagatgttcaaaatatttagttcattaatactgcttaaaggaatttatcctaacaaataattaaaagaggaggtttttctgcataaagatgttgatcaaaactcccatagcagaaaatttttaataatcctataaatgataatgaaaaagccactgaaaaacaagagggaatatttgaagccacaaaatgttatgagctatgaggagtcttagaaaaatggttatgatttactaatttattcatagatgcctctctatgccaggcatagattgctttaaaatggaaaaataaaagccttccaagtagataaaactgaatattttactaagaaaactttgtgaaatatatggaagagaacatacaacaaagaagtgttgtttccgagtaataggattaggagtgattttttttctttaaacttccttgtgtgtgtgtgtgtgtgtgtgtgtgtatgtatacaacttaagaataatgaacaaaaagcattttgtaattcttcataatatactatagagcattactattattttttacaagagattgaccaagaactctaccaggaatatttggaccacggaactgagaaacactgtttacagtaggtacaacttcctttaaaacatacaccttttaaggcattcattcatccatccatccatcccacaaacacttgtcaaacaactaccagtgatagcaatgcagtaagctctgatgagttcctgctcttgggatgcacagtctagcaggcagatataccaggacaagagtaagatgtacagacagtttttaggggcaagagcctccaagtcaggcccaggggaatcagagaaatcaggatttaagttgtcactaaaagggtaagtcagagttttccagtcagacaagcatggagagctcttcagtgggggctcacgtgtagttcagacagtgaatactcacagcagagttttatgcacagagagtgctacaattgatagcacagactctttgttcaaatcctacctacctcatttactagtgtgaactctgggcccttcagtatttttatctgaataataggggtgataatacatacttcataggattattgtgtggcttaaatggagaaaaacatacacacagtgcacatggtagacactgtatgaaaaacaatatggtcatggaaaggtggaagacagaacaatatttaagatattcaatgagaaagtaggtgtttttagtgaggttccaaactcaagtgttaggagcccagtactcctgggaacgtaaggataatgtcttatatcttattctctcagggtactgatgttaagtttatttgtcagactatttttacttttgacaagttaaataaaatggtggagatcgcagcacctctccccagtctgattcactttagtgattattcatactgagagctcatgtttgcttcattataagaacaggtctcaccttctggctttcaaaaaacctggaatatcttcaccagtacagataaacaaatggtaatgccaagactgtcagtattttccaaggaaggaaacaggatatgtatggtaggcctatgttttccccaatctgccttaaaatccaaatctcaccttaggctggtggggactttaattaaaattagaatgtgaaccttcttatcatgaagctatcacggtatctcagttccacttgaatgttgttatataagtgaaattctaaagtatttcctaaaatacccattctgtatgtaggtatgtgcttctgcttgtctagggatgacttatttttcattaagttctctgaaatgagaaaatgagaaatagaattggggaaatgcaatggtattctcaatctttactctgtattggtattggttagtcttaggttcagagatcctggtcatgtctttccagcttctaagaagacaaagacactggtggagctggtgcacacctttgtagaactacctctactcaccctacagtgatgtcaaaaatgttgcttccaacagagctggacacagccatgtcccctaaccccttccgggccactatgacactggtgataagatcagggatggaggtcccagcagccaagatggtcaggcccataatctcttcactgatgccaattgtctctccaacctaaatgtcaggacaggaataaacatctcagtgtttgaagttacaaaatcataaaaatcacaaaaatttcaatgcgacctccttttaatgcatttctatactgtgctatgcaaagtgctgagatgataaagatgaataagccacagtcattgctaatagagtttatgcttttaggatattcagacccaaggcatcaggaatgttcacatgaaaattaaacagataatctcaaaaaagagctctagagggctagagtgtagcctttatatggtgctttctaagattgagtcagggaagctgcaggattagaggtagaaaggccaattggccatggaatccagggggcagcacctggcagtggcaccaagtcctgtggaagatttgcccttcaacttactaccaaaaccaaggactgacacccagggtctccattctcctttagcatctcctagtgtctataatctattctgaaacacttcaagatgctataatttccactggaatctcgattctgggtgtttcgggttttggtaacacatagcaaagcaactgtggagaagcaaaatccagaaaatcagaggacctgggtccaagatctggctctggtatgtgttaatttcttgacattttgcttactgtaccaattatatgtcattgatcctcactttctcatccataaactggggataataatacctaccttaccaggtacttgtgaggactaaatgataatctgtgacagactctttgtgaatagtacattattattgaaaagcaaggggagggtggctattactttttttctttttttttctttttttttttttggtctttttctttgccttttaagactgatgagttctattttggaaggttggtctagcctcacgtggaagctcctccattctcttgagcaatttgtttgtcttcttgggactttttagaaaaacttacttattttctttagagatgggttcttgctctgttgcccaggctagagtgcagtggcacagccacagctcactgcagcctcaacctcctgggctcaagcgatcttccaaccttagccttcagagtagctgggaccacaggtgagcactgccacacctggctagttttttttagagatggttcttactatgttgcccaggctggtcttgaactctcggcctcgagatcctcctgccttggcctcccaaagttctgggattacaggtgtgagccactgtgcctggcctcttgggacttttaaaacctattcatgttttgctggacttggtgaagtgtggctctgaaaaccttcaagataatgctttccatctggtttccaacaggttacctgatgatgtccagcattttttgaaaaaatttaaagggccaaaatagcatataagaataaagccttttagggaatagaatacactcatttctaaatcctttttaaaaaaattcttatttttataagaaatagtatgattcctactagcttaaaagcatatttttgttttgatggtcatgcctgctccagagcctggtgagctgaactagcttaccctgtcctcatgggacacagaatcactgctccccattagtaagttccatgtatgcaggatcctcaccttggtcaccacgatctccctagttgacagaacatacacagcctgatacatggcaggctcttaatactgatttgctgagtaagcaaatcaatctgcatacctaggtgatttcactagtatgtttttctgctgattctcctagaaaaagttcaataagacttttgcacaggagtgccctatttgagcaaaatattctcaaattgtcagttttttgttagatttggagtgaagcattgccaaagactgagcagatgctgactaaacaactgttactgtcggcaagttccaatctgtttaaaacattcttaataattaaattcttggagggaattctaaagtagtgactgaaaaattatttgctgggcacaatgccatgcacggtagttccagctactcgggggttgaggcacgaggatcacttgagcctggacatttgagaccagactgggcaatatagcaagaccttgtccccgaaatataaacaaaataatttgtatttggagtttgaatgctactatatacaggaaaacataggaattgaagaggagaaaaatggtggtgtggttaagagcactggcttgggagatgacagtgctgggtacaaatcctagcttgccactcctagtgcaagttagacaacttccctgagtctcagtctttcctatctgtaaaatgaggataatatccactcagaattgttgatgactatatgtgagatgcaaatcatacagcacagtgtcaggtataaagcaaatgttaaataaaaatctagttttttttttaacttaatatgttttttttgagacggagtctcgttctgttgcccaggctggagtgcagtggtgtgatctcggctcactgaaacatttgcttcctgggttcaagtgattctcctgcctcagcctcccaagtagctgggattacaggcatctgccaccatgcctggctaatttttgcatttttagtagagatggggtttcaccacgttggccaggctggtctcgaactcctgacctcaggtaatccgcctgccttggcctcctaaagtgctgggattgcaggggtgagccacggcacccagccaaaaaaccagattttataactcagacattactcctttccctctccaatttattagactgtcaggtgtctggcagcaggaacagaagtgggcttactggggccaattcacatcatggaaaacttcatgagaattttcattagacatcaaacccctggtgaatctgtgtggctctagaaagccttttgtggaagaagaactagtcttcataagcttgttttgagtacatttcactcaagttaacttttgtcaaatcagtaaagatgatgggcacatggacgggacagtactctgaaaaatcagggagcatcagagaggcttagagcttttaatagaaagaacatcagcagtcttttgggggaaattacttcattttcaaaaaaaaaaaaaaaaaaaaaagcaaattaggccactcagaggaggccaaactccatgctgctcccaatattttgtgatgcagttctgtgccttggtttaaggaggatctgaaagaatgctatagtggctaaatgagacacaaggtcttagttgactcttaaaattaatttctaatattagatgcaggattgactttaactacaggttgtcatcacccattaaatttattaaagtgcaaaaacaataagaaacaagaacaacaaaaacaaaagataaaggcaaaaaaaaaaaaaaaagccaagggcaaattatgttaaagcattgtaggtgaagggcatttattttttgccaaacagtagccaaattatcaaatagcatttatgataaaagtgttgataacaaaagagttgaacactatataactgctatggattttatagttcagaagtacaaacaacagaattagagctagacttcttggaacagaatctattttgttcagctgtctgggtgtttttaaagaagtatttgtataggagaaaagagaaacttctcttccatcaatgaaaagtaaggcttccatttatggctttcattcgtcttggctttttaaaattattattgtttcagccattgaatttgtgttccttttctttgaaagaatggaaagaaaacaagactggaattaaggtaatcattaaaaagaaaaagatggaaccctgcatgatgttttataaaacggcaaaaaagaaatatctgggaaacaacatatcccagcaagttagaaaaacaccattttttctttattagtacatgaagaaatagaagatgattattaagaaaaactattatatgttataaatggcaaacagtcctttcagcctggacatctggaggctgaaaaccagcccaccttctgctgtgatttctgccaggtgttggtagcaaatgtctctcaatgagtgtataaaataatgactccaaggcacagagaacttgctcaggaagccaatgattttttggaaatatccaggaagagtaatctgaagtcaaatgtcagtaaaataactgtgatatgaataatataaaatatcatgtagaaataagacagtgtatcagccaacattttctgtggattttgctagtaacatgtattcttttaaaaaccaaggtatgctttacatagagtaaaactcattcacctttttaaaaagtgtacagttctgcaaggtttttttttcctatttctttacttttttttttttttttttttttttttttaaaagacagggtcttactctgccacccatgctggagtgcagtggtgtgatcttggctcattgcagccttcacctcctgggatcaaatgatcctccccactcaacctcccgagtagctgggactacaggcgtgtgctaccatggccagctaattttttgtatttttgtaaagacagggttttgccatgttgcccaggctgatctcgaactcctggggtcaagggatctgcctgcctcagcatcccaaagtgctgggactacaggcatgacccactgcaaccagcctgcaagtttttacaaatgtatgcagccatgtttctccacatccttatcaacacatgctactgtttttttttttttttttttttttatagccaacctagtggttgtgaagtgatatcttggattagtttcaaacaagtttattgagatgtaatttacataccataaaatttagccattttaaagtgtataattcaatggtttttaatgtattcagagttgtgcagccttcataatttaggttttgaacttattcatcatccccagaagaaacccatacccactggcagtcactccccattttcccccaacctctccaatcctaggcaactattaatattaacctattatatgtctctatagatttgcctgttctgtatacttcatataaatgaaatcatatgatgtgtccttttgtaactggcttttttcacttagcataatattttcgaatttcactcatgttgtagcatgtattggtacttcatttctttgtactgtgtaatattccattgtatggatataccatattttgcttatccattcatcagttgatggacatttgggttgttttcactttttggtaattatgaataatgctactttgaacatttgtttacaagtgtttgtggacgtatgttttcatttctcttaagcctattcctaggagtggaattgctagatcatatggtaactctatgtttaatgttttgtggaactgccaaactatttcccaaagtggctgcactgttttacattcctatcagcagtatgtaaggattctaatttctatacatcctcatcaacacttgttaggttctgtctttttgattatacccatcctagtgggtgtaaagtggtatcttgttatggttttgatttacacttctttaattaataatgatgttgagcatattttcttgtgctttttagccatctgcgtattttctttggtgaaatatctgttcagatcttcaaaattaggatacttgaagatgcttgccttcctattatggagctttaagcttgtatcttggatacaagtgctttatcagatatatatgatttgcaaatattttcttccagcctgtggttttccttttcctttttaatggtgtttcctgaagagcaaaagttttaattttgatgaaattaattaatcaattttcttgctttcatggatcatgctttggtattgtatcaaagaactctttgcctggcttatggtcatacagattttttttctgtcctctagaagtttgacagctttacaaactcttacatttcaaactatgatgtgctttcagttaaattttatgtaaagtatgaggtaaggatctaagtttatttattttggcatatggaaatccaattattccagcatcatttgttgaaaagtctattcacatgttctcagtatatatttccttatttcaaatttctatatcttatttatgttgccaagtataataattttaggattatattaaacaaaggatacaagtgggaagtttggaatttatgtagtttataatagagattaaaagtatgatttttggagttgcagagtcctgggttaaaatctcagttctacctatgtgattttgggtaatcttaccaactttaagcttaacttctttatctgtaaactgtggataataatagtacctgcttcataggctttgaacctatgtatagggttactgttaagattataaagacaaagggatgtgaattgttgggtgtgtaggacatactcaattatcaatagttaccactattatctttgaaaatgtgaaacccttgaatcttactcttcattcatgtttttcaataatgattactgagagtgtattcttgtgatgggcattgtgactcatattgagttaaaaataataacaatacatcatcatttatgtaaagtgaagctcaaggaagaggctattttgtctccagatgctttcctagagccagttttaaactgctggtgagaacgtgaggtgagtggctgctcaagataaagtcagtactactgaaccaggcaaaatcttgacattgctctcaggtctgggttgtcctggtgtctgtcaggctgcagaggcaagaagtagttagacttgcctgcctccacatggctgtccagaggctatgctgatttaattccatgctacagccagaagactagggaaagttaagtggataaattcctctagtcctggaatgctaactcgtctgtgtcacacccaatactgttgtggcagttgcagaaagcaaacacaatgattaaacacttgacaatcaggactggagaaaaacaaggcagaggcatgtcactatcaaaatcttacctggtgcgcccaccagaccatcaagtaagagaatactgcaatccaggtaatggagccaaagaacgtgatgggaaaaaacttcctcgatgactgaaagacaaccaggaagagttgagaatatcagtgttatccattgagactgatctggaaatccaaagctaaagccaccattgtagcaatttctctagcatttcctgcatcttagtaggattggcaatcaaaagaccctactcactcctgatcaagctgggacagtaagattctcccttggagatgtgaaattgataggaactgagtgatcacagtgctggctcctgagatggaaatcttgaagagaatgtctgttagttcctgctattagatgtttagattccctctgctcttgtcctttctaaggcctggttttttggcctttccttcaatattaacaccatattctccctcctcctttttctttcttttgctccagagtttgtcagaatcagtttctattgcttgcaaaccatgaatcctaacaatccatatgccaggaaacctatgggattaattccattgaataagaaatgggaaggatcagcaggtttaaaaatagattgactcatcttacagtaccacaaattatcaagaaagtcacacagaaaaagccaccaccacaacttttatagattctggatgatggccattctccaggacactggaaccacccatggaccagagtagacagaggcagaagcgcccaattgtactgatttccactgagatggcagatcagacattgctctcaagaatgttttctctcctgttcaccaccccaaaatatattatgttcaattctgcttctagaagtagactttatgctatctcaggcataaagtgtgagcatttttaaagtttcctagaaatagccaaaaaatcagacacttgaaatgcagtgtttcttacccagtcccactacagagaaacccaggcttgcactgtagtggtgttcttttgatgtcctttgttgaaaaattggggtcttttaaaaacacactcagacagcacaatgctgtcagagagcctcttgcctattattgccaaacactttatttgaaagctttccacgttgagaaacaatcccactttttgctttgataatgccatccaattttatctagagaaatgaattttagagttgacttgtatgaaagtaatctcaattgtccgaaaggctgaccttgggcagtcacacagaacacgttctgtcatggcttttgagagctccattaaaaggaaaagataaactcatacatggtaatcttttgaatatcaataatgatgaacacagtctctattgctccaaaccaggcttatgttttctttactaatttcaagttttcaatatatatttcttatgatcatttgcatggttctgttaaattttaccccatacatttctttaaatgattgctgttttgtggggccgtttgttagcttggatgactgtaagaccaagcaggtttgattaaatcgggggagggcatcaggccacagtgagtagccaaaaccttaccctcaaatgcttttccctgctccctttctttcttagaagaaaaatattttggacaaggactcagacccctcctagggacctaagcgctttaatgggtaatgggggaaataaaaaggtaatcatttttttaaagtggagttggagaccttcgtttttttttttttttttaagatggagtctcactcggtcacccaggctggagtgcagtggcatgatcttggctcactgcaacctctgcctcctgggtcaagcaattctcctgcctcagcctcctgagtagctggaattacaggcacctgccaccacaccccactaatttttttgtattttttagtagaggcagggtttcaccatgttggccaggctggtttcaaaatcctgacctcagatgatctgcctgcttcagcctcccaaagtgctaggattacaggtgtaagccaccgcacccagccattagatctttacttataaaagcagcttttttttttttttttttttaagctaggaaatcagccggattctggagaccgaattccctgagccagtgctaagagatgaagttttccaaggcatttagcttattaaagttcccatccttttcatctggtcacagtcactgtttcaggatcctacgtgcaatgagggtttcatcttccatggctgtgctctgttacaggaaagagaagaaccctcttgccacgtggggtcacgtgtgtgattagagccccaaccaatggttgattctgggcaatgtatgaggacaatgaaaagctttctacatgccttaaggtgtggcataagtactagatgtcctaggagagtcctcatttcatagattgctcgttttccaggttagctcatttactaaatgtataattattattttaactttgtacctctgcctgtttattctttgagataacttcacaagtcagaatcaaatcatttgaacatatttctcatctgaaaaatatcataactgagctacagaaaattcctagccaaaaggtataaagcaaggtatcagaaaaggaattaaaggaactaaattcaaatcaacatactagggaaaacctctctaaatcaatatttgatgcccatgattcttaatcaagaagccaattagtaattaatgggcatcgaaccatacctaatgttgcattaggggctcaatgaagaaggctaaaaatattctttgtgaattttcagtcttcatcataagctagaggtagataaagtctgagaacttactctgtacccagatcctgaactagagataaaattcaaactaggtcagcctgactgtaccacacgtgctcccaatatctagattatactgactctttcctaaagaaaaacagggccaataatgctcaaaatataccccgccatatacataatgatcatgatcatgatcatcataccaggctctgctctgaatgtcagaaaattaaaaaaagcatcagggaagtagaaactagcattccagctgtatggccatctgcctcgcccaacctcccatgttgttcctgctttggaagtatcaacgtttcattcatcagcagttgggctaagtgtttcctaactgttgaactactttaccatttccattttcacaccccaggtaatcacttctttcatttttcttggaccattccccttacttggacagcatggtctcattccagacatctctgcccagtagcaactgtacagtcatttagttaccagtgtcattggaaggaagaaaatagctcttggagccaaggtctaacatgacaatttatggttatagtaatgggggttcatcctgccatctgctgggatggacctcatactaattagcaaataagcaaattgcatccatgtgctggccattttgtgcccatgttgtggtttacttacataattgacagtggatgctctgattagaagcttttggtacatcagagtgatatcggcttggcttggaaaaagatgctggacattagctggttgtacaaattagctatatccttactgatttaaattcaacaaatattcactcagcatctactctgtgtaaggttctgggacatatatttaacaaagacccccccccaccccccaaatcctactaaagatttaaagtgtggtctctggattaatatgactggtattgaaatctctgctcacaaattaccagcaatgtgacctgagacaaattatttaatctctttaagcttaggtttcttcatctgtaaaatgggagaaataacatctagttgttttgaggacttcatgtacataaaatgtctagcaaagtacctcgcacataagtgctcagataattatatttgttattagacaatatagtcatgcccttgtattcatgagggttccaccacccctgaggataccaaaatctgcagatgcccaaatccataatatgaaatggtggagtatttacatataacctttgtgaatcatcccatatactttatttatttatttgtttgtttgacagagtttccctgttgttgcccaggctggagtgcaatggtgcaatcttggctcaccataacctccaccttgtgggttcaagtgtttctcctacctcagcctcctgaggtagggtttacaggcatgggattacagggatgtgccaccatgcccggctaattttttgtatttttagtagagacagggtttctctatgttggtcaggctggtctcgaactcccaacctcagatgatcctcctgcctcggcttcccaaagtgctgggactacaggtgtgagatacctcacctgactcccatatactttaaatcagctctaaattatttgaggccgaatagaatgtaaatgctatgtaaacagttgttaaattgtattgtttttatctgtattttttactgttgtattaaaatttttttcctgaatattttcaatctgtgattgtttgaatgcagagcctgcagatatgaagagccaactgtattctcattttagtttttaagagataaagaaactgataattggggaagtgaacatgactgtgaagacctggcccagagtcttggctttgcgtctttctagctgggtgtgcttgaataagtcaccaaacctctgtgggtgtcaattactttatccttgttagaccttgcttggcacatagtagacactgaatagatacttgatgaatcaatgaataatagaaattgcaaacatctagctgggttctcaggttccttcctagttctaatgggtcatgttttcatatctcattagatgcattcttgttttgcaggagtatctatcttagtcatgagagaagataactttttcggtccttagtttattttcagttttcatcaaagacttggtcctcattgaagtttatattttagttcttttactttggaaacaaagccattaataaaactgtaagtgtaaagcccatattaattatgtgagctgaaattatgcatggttcaacaaacactgtcatacaatttgcatataaatgaagcagaaataaaagctagtgggagtactatatactctgaaactataagtatacatgaaaaaatcatgttttccttgtaattactgtcaaggtttggtatgttcatcttcttgggcaatcaaaatctacagaagaggcagagctgccaggccctaaggaggggcaaatatgtattagttaatttttcccctctctttcctctccgtatgtattttctcaagaggtccctgtggaagcacataagttctatggtggactgcaaaaatgggcacaatactttgctgctcctctcatcaagaggtgaggtctatttttccactcttcgaatctgggctggccttatgacttgctttgaccaaaagaatgtattggaagtgacagcgtgcaaatttcaaactagatctcaagagggctttgtagctttcatacttgctgctctcggcactttgccattatgtgactaagtccaggctagcctgctttgagataagagagtatgtggagcagagacaagctgttccagcttcaatagccctgtaccaaccagctcccagccattaactgagcaccactaagaccagcagctgaactgtccagctgagcacaacccaaattgccaattcacagaattatgggctaaaaaatgtcttgtattaagccactaggttggggtggtatgttacaaagcaaaagataactgatacaaggtcaaatctaacaaaaatcttctaactaagcatgatcacttactggatttgtgtcaactggcatggtttctttcatttggcatattgtatatgcagaatacacccatatatcttccaaaccaatatgctttgtgaataaactgggaccgtcctgggtaatctgggatgtaggatcactttaaatgtgcagtagcttttttgatggttatctcatgctttccttaatcacagaatgtcatggctggcagggaatccagaaaccttctgaccatttattcacagaggggaaaaaattcggtccagagttgagaagtgcttttcctaatgttgtacagctaatcagctgtggggggaaaacccatcacagtcaatgtggtacaatgaaaatgatctggagtcaggggacttgggttcaaatccagcttctctcactaatacagctgtaaagtcttgctctgtggttatatgtggccatgcctggtttcctttactagacttagagtgccttaacaatataaattgtacattttttgtctttgtatctctttttttaaatacactttaagttcttgggtacatgcgcagaatgtgcagctttgttacttaggtatacatgtgccatggtggtttgctgcacccatcaacctgtcacctacattagatatttgtcctaatgttctccctcccctagccccccaccccttgacaggctccagtgtgtgatgatcccctccccgggtccatgttatctcattgttcaactcccacttatgagtgaaaaaaatgcggtgtttagttttctgttcttgtgttagtttgctgacaatgatagtttccagcttcatccatgtccctgcaaaggacatgaactcatccttttttatggctgcataatactccatggtgtatatgtggcacattttctttatccagtctaccactgatggacatgtgggttggttccaagtctttgctattgtgaatagtgccacaataaacatatgtgtacatgtgtctttatagtagaatgatttataatcctttgggtatatacccagtaatgagattgctgggtcaaatggtatttctaattctagatccttgaggaattgccacactgtcttccacaatggttgaactaacttacacccccaccaacagtgtaaaagtgttcctatttcaccacatcctctccagcacctgttgtttcctgactttttaatgatcaccattctaactggtatgagatagtatctcattgtggttttgatttgcatttctctaatgaccagtgatgatgagcttttttttcatgtttgctggctgcataaatgtcgtcttttgagaagtgtgtctgttcatatcctttgcccactttttgatggggttgtttttttcttgtaaatttaagttctttgaagattctggatattagccgtttgtcagatggatagattgcaaaatttttctcccattctgtaggttgcctattcactctaatggtagttccttttgctgtgcagaagctctttagtttaatgagatcccagttgccaattttggcttttgttgccattgcttttcgtgttttagacatgaagtctttcctaatgcctatgtccagaatggtattgcctaggttttcttctaggatttttacggttttaggtcttaaggtggagtctttaatccatcttgagttaatttttgtgtaaggtgtaaggaaagggtccagtttaagttttctgcatgtgactagccaattttcccagcaccattgattacatagggaatcctttccccatttcttgtttttgtcaggtttgtcaaagattagatgattgtagatgtgtggtgttatttctgaggcctctgttctgttccattggtctatatacctgttgtggtaccagtaccatgctgttttggttacggtagcctagtttggagtcaggtagtgtgatgcctccagctttgttctttgcttaggattgccttggctatacaggctcttttttggttccatatgaactttaaagcagtttttccaattctgtgaagaaagtcagtggtagcttgatggggacagcattgaatctataaattactttggaaagtatggccattttcatgatagtgattcttcctatccatgagcaggcatgttgttccatttatttgtgtcctctcttatttccttgagcagtggtttgcagttctccttgaagaggtccttcacatcccttgtaagttgtattcctaggcattttattctctttgtagcagttgtgaatgagagttcactcatgatttggctctctgtttgtcttttttttttttatctgattctaagaaattttctttttttttaattttttatttatttatttttttttattacactttaagttttagggtacatgtgcacattgtgcaggttagttacatatgtatacatgtgccatgctggtgtgctgcacccactaacgtgtcatctgtcattaggtatatctcccaatgctatccctcccccctcccccgaccccaccacagtctccagagtgtgatattccccttcctgtgtccatgtgatctcattgttcaattcccacctatgagtgagaatatgcggcgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcatttgggtatatacccagtaatgggatggctgggtcaaatggtatttctagttctagatccctgaggaatagccacactgacttccacaatggttgaactagtttacagtcccaccaacagtgtaaaagtgttcctatttctccacatcctctccagcacctgttgtttcctgacattttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcactgtagattctggatattagccctttgtgagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgtattggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggagatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctttttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcggtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtgtaaaattctcttttttggttgtgtctctgcccagctttggtatcagaatgatgctggcctcataaaatgagttagggaggattccctctttttctattgattggaatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgctggtttcgaagaacatctttatttctgccttcatttcattatgtacccagtagtcattcaggagcaggttgttcagtttccatgtagttgagcggctttgagtgagattcttaatcctgagttctagtttgattgcactgtggtctgggagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttgcctggatatgaaattctgggttgaaaattcttgtctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttcttgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttcttttgattcttttttctctaaacttcccttctcgcttcatttcattcatttcatcttccattgctgataccctttcttccagttgatggcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggttttcggtgtagatgtcctttctggtcgttagttttccttctaacagacaggaccgtcagctgcaggtctgttggaataccctgcagtgtgaggtgtcagtgtgcccctgctggggggtgcctcccagttaggctgctcgggggtcaggggtcagggacccaattgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcctggtgcgccgtttttcaagccggtctgaaaagcgcaatattcgggtgggagtgacccgattttccaggtgccgtctgtcacccctttctttgactcggaaagggaactccctgacccttgcgcttcccaggtgaggcaatgcctcgccctgcttcggctcgcgcacggtgcacgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccttctctctgtttgtcttttattggtgtatatgaatgcttgtgattttttgcacattgatattgtatcctgaggtgctgaagttgcttatcagcttaaggagattttgggctgggacaatagagttttctaaatatacaatcatgtcatctgcaaacagagacaatttgacttcctcttttcctaattgaacaccctttgtttctttctcttgcctgattgccctggccagaacttccaatactatattgaataggagtgatgagagagggcatccttgtcttgtgccagttttcaaagggaatgcttccagtttttgcccattcagtacgatattggctatgggtttgccataaacagctcttattgagatacgttcaatcagtgcctactttattgagaattttttaggatgaagggtgttgaatttttgttgaaggacttttctgcatctgttgaaataatcacgtgctttttgtcattggttctgtgtatgtgatggattacatttattgatttgcatatgttgaaccagccttgcatcccagggatgaagccaccttgatggtggtgcataagctttttgatgtgctgctggatttggtttgccagtattttattggggattttcgcatcgatgttcatcagggatactggcctgaaattttctttttttgttgtgtctctggcaggttttggtatcaggatgatgctggccttgtaaaatgagttagggaggatcccctctttttctattgtttgaaatggtttcagaaggaatggtaccagctcctctttgtacctctggtagaatttggcagtgaattcatctggttctggactttggtaggctattaattactgcctcaatttcagaagttgttattggtctattcagggattcgacttcttcctggtttagtcttgggagggtgtatgtgtccaggaatttatccatttcttctagattttctggtttatttgcatagaggtgtttatagtattctctgatggtagtttgtatttctgtgggatcagtggtgatatcccctttatcattttttattgcatccatttgattcttctctcttttctttattagtctggctagcagtctatccattttttgatcttttcaagaaaccagctcctggattcattgatttttttttttttgaagggtttttcatgtctctatctccttcagttctgctctgatcttagttatttcttgtcttctgctatcttttgaatttgtttgctcttgcttctctagttcttttaattttgatgttagggtgtcgattttagatcttttctgctttctcttgtgggcatttagtgctataaatttccctctacacagtgctttaaatgtgtcccagagattgtacgttgtgttgttagttctcattggtttcaaagaacatctttgtttctgccttcatttcgttttttacccagtagtcattcaggagcatgttgttcaatttccatgtagttgtgcagttttgagtgagtttcttaatcctgagttctaatttgattgcactatggtctgagagactgtttgttatgatttccattcttttgcatttgctgaggagtgttttacttccaattatgtggtccattttagaataagtgcgatgaggtgctgagaagaatgtatattcttctgatttggggtagagagttctgtagatgtttattaggtctgcttgttccagcgctgagttcaagtcctggatatccttgctaattttctgtctcattgatgtgtctaatattgacagtggggtattaaatctcccactattattgtgtgggagtgtaagtctctttgtggatctctaagaacttgccttatgaacttggatgctcctgaatggtgtgcatatatatttaggatagttggctcttcttgttgcattgatccctttaccattaggtaatggccttctttctcttttgatctttgttggtttaaagtctgttttgtcggagactaggattgcaacccctgctttttttttttttctttctatttgcttggtaaatcttcctccatccctttattttaagcctatgtttgtctttgcatgtgaggtgggtctcctgaatacagccactgatgggtcttgacgcttatccaatttgccagtctgtgtcttttaattagggaatttatcacatttacatttaaggttaatattgttatgtgtgaatttgattctgtcattatgatgctaactggttattttgcctgttagttgatgttgtttctttatagtgttgatggtctttacaatttggtatgtttttgcagtggctggttccagttgttcctctccatgtttagtgtttccttcaggagctcttgtaaggcaggcctggtggtgacaaaatctctcggcatttgcttgtctgtaaaggagtttatttctccttcacttacgaaactgagtttgcctggatatgaaattctgggttgaaaattcttttaagaatgttgaatattggcccccactctcttctagcttgtaaggttcctgcagagagatctgctgttggtctgatgggcttccctttgtgggtaacctgacctttctctctggctgcccttaacaatttttccttcatttcaactttggtgaatctgatgattatgtgtcttggggttgctcttctcaaggagtatctttgtggtgttctctgtatttcctgaatttgaacgttggcctgtcttgctaggttggggaacttctcctggatgatatcccgaaaagtgttttccaacttggttccattctctccatcactttcaggtacaccaatcagaggtggatttgatcttttcacatagtcccatatttcttggaggctttgtttgatccctttcatccttttttctctaatcttgtcttctcacttcatttcattaagttgatcttcactttctgatatcctttcttctgcttgattgattcagctatttatagttgtgtatgcttcacagaattctcatgctgtgtttttcagctccatcaggtcatttatgttcttctcgaaactggttattccagttagcaattcgcgtaaccttttttcaaggttcttagcttccttgcattgggttagaacatgctgctttagctcagaggagtttgttattacccactttctgaagcttacttctgtcgagtcatgaaactcattctccatccatttttgttccattgctggtgaggagttgtcatccttgagaagaggtgttcaggtttttggaattttcagcctttttgcgcgggtttctccccatcttagtgaatttatctaccgtcggtctttgtagtcagtgaccttcggatggggtctctgagtagatgtgctattcctattttttagtttttttttcttttttttttgtgacagagtctcattctgttgcttacgctggagtgcagtggtgcaatcatggctcactgcaagctccacctcctgggttcatgccattctcctgcctcagcctcctgagtagctgggactacaggcacccaccaccacgcctgcctaattttttgtgtttttactagagacgggtttcactgtgttagccaggatggtctcaatctcctgaccttgtgatctgccctcctcggcctcccagagtgctgggattacagccgtgagccactgcacctggcctagttttccttctaacaggaccctgtgctgcaggtctgttggagtttgctggaggtccactccagaccctgtttgcctggatatcaccagaggaggctgcagaacagcaaagactgctgcgtgttgtttcctctggaacctttgtctcatacgggcacctgccagatgccagccagagctctcctgtatgaggtaggtctgttggcccctactgggagctgtctcccagtcagtacacatgggtgtcagggacccacttgaggaggcagtctgatccttagcagagcttgaacgttgtgctctcttcagagccagtaggcagggacgtttaagtctgctgaagctgcacctacaaccgccccttccgccagatgctctgtcccagggagatgggggttttatctatatgtttgggggtactgcctttttttttcagtgatgcccttgccagagaggaggaatctatagaagcagtctggccacagaggccttgctgagctgcagtgggctccacccagtttgaacttcccggtggctttgtttacactgtcagggtaaaactgcctacttaagcctcagcactggttgacaccccttcccccaccaagcttgagcatcccaggttgacctcagactgttgtgctggcagcaagaacttcaagttgtggatcttagcttgctggactccgtgggggttggacccaccaagccagaccacttggctccctgccttcggccccttttccagggaagtgaatggttctgtctcactggtgttctggcaccactgaggtatgggaaaaaaaaaaacaacacaaaactcctgcagctagctcagggtctgcccaaatggctactcagttttgtgcttgaaacccaggacactggagggtatcttctggtctgtgggttgcaaagactgtgggaaaagcacagtgtctgggccagagtgcactgttcctcatggcacagtccctcacagcttcccttgggtaggggagagaatttcctgaccccttgcacttcctgggtgaggcgacaccccacaccccaccttagctggaaatgtggaaaaatcacctgccttctgtggcgatctcgctgggagctgcatactggagctgttcctatttggccatcttgccagcaaccctgtctttatgtctcttaagcactggccaaggcccagtgtttggcacataataggtgctcaataaatatttgtgaaggaagttgaaaaaaaccaaagtgttcttcctaagagtcttatttctgcttggaatagcacagagtactcagaaaaacaaaagaaatccagtccattccagggctagcacttgggggagcaatgaagtaaagccccgctggctaccctgcccattctgcaggtgctggctctcagagggggactgcacagggagcagtggactggggacagctctgttttcttgctctgtgcctctccggattgtggcatcagccagagcagttgtcatgacccacgtaacgactgccttgattgatttttgttggttttccaaaagttaccagttaggaagttgggagcttttgatcttccctaacagcttctttgacgtttcaactaggattaccaagaggataaacactttgccagccctttctctgagagttcctcccaattctgagagtcaagggccttgacttactggcatcttcctcccattcctgcacatcttcctgagtgcctcaatggttgtatgcaaacatcctctcatcaaccaatctgcccccatcttctgggggccacaccacatgaggccccttttgggaatttagaaaactgtatctgtctccctgattttcctccctagggccacacaaaagcattggactaaacagcagagcaagagagagagagagacagacagagagaggagagacaatgcaagcatatcttagaaatgtcagtgtggtgtgagccaagaaaaatcaaacacattcagctatttggttgtgggttttcaggaagccaggcctttgcatagtgcagatgctgtaaaatggtatcttgaataaagaaacttaaatattgctttaagtgagccacacctgtgtcatgcatcctttaccaggaaacctatactgctgggagtccatacaaggagtcctttcttgttgtctacttgacaagacatggctctccactaggctgcattatttaagggccaaggtaatgggatggggtttttcttctgtctttttcaaatgaaggagctcttgaagacttatgataaattatgctggaagttatcaaaatattctattccaagtgcttttagaaatgattttttttaaatgatttttttttctactttgtggcatcactaaatatgaagcaaagcccaagccatgtggtcacatagacctgggtctggatctcagccctaccttctaggaaatgaccaggtataaattaacttctttgtgcctaagtttctttctacttatgccaacaatatacatattcctaccctagatgtttcctgaaattacataatatagtttactgtggaccaataactcaaggccttgggctctcagggttgggaaggacttttagaataaaggctggcaaaatgttcatcctcttgccaatctgagttgaaagatcaagaaggtattagaccagatcaaagtctcctgattggcaactgtggcaaaccaacaggaatcaatcaaggcagttggttatgacgactgccctggctgatgcacctaacaagaaaatggagctgtccacaatgctctcctccctgtgcagtccccctttgagagtcagcccctgcagcatggccagggtagccactgggacttctctcattgctcccgccaagggccagccctgggatggactgtatttccgagtatactgtgtgctgttccaaacagaaatgagactctcacgaggaacatttagtgcagaatctgatgcatattaggtatacagttttgttgaatgagtttgtgtgtgtggtcctatactaagaagtagagctgtttctccttccctctccttagttctttcacctctggggcaatggcccaagaactcacttcaacaacagtgggtgggtgtattctcttgatttggtctatactcaggttgtaatttgctgatgttgttgcgttcggagcacccagtatgtgataatggtagataataaaatcgattaaagtaatgatagtaaacatagtcgattaaagtaatgatagtcacaagaatgttcaagaaaatgtgagtaaccttcctgcttcagaccttcagttgcccttcttaccttctcagagacaaacgctgtgggggttttaaaacatgtttgcaaattctttgacactcttcccaacaggagagtgatatgctatatgacactgacgtattctaggtaaactttttgtttcctccccctttaatcaagacacacttaggactgctttggtcaatagggcatagcagaagtgaatctatgtaacttctgggactgaatcatcacagaccatgcagtttctgccttctgtcactgcaacattcactcttggagtcctgactgacctcttatgtaaaacatttcactatcctgaggctaccatgctgtgaggaagcccaagtcacatgaaaaggccatgtttaggcattccagtagaccgtcccagctgagcctaacctttgaatcatttctgcccaggtgccagaaatggcaaagaagcctccagatgatggtagccccaagatgagatacacataacccttcaagtctttctacttcaggccacagacataatggagcagagacaagccatccacaatgtgccctattcaaattcttgatcgacaggatccaagaaaagactaaaaggatggttgtttcacaccactaagttttggggtagtttgttatgcagatttgataacctgaacaatcagtgtgattgtgtgtctgctcagagaaatctgtatattcttaatgtcactttctctttttccttaaacttaaatattttttcttgttacataatagttgtacctatttatggggtatatgtgagattttgatacaagtgtacttcctttttccttttaacacaaactgaagcagactatgcaccctgttatgtaccatatgttttacaagggaactatttttaaaatgctttacttacaggtttgcgaacgtcaggtaacgtaatccagagaggaaacactatggggaaaacaatcagaaacgtgacttgcttgcgggtttcagaaggccaggcaaggctgagaggctggtcctcctcctcatcagcggtctgtggtagaaaaagaggtaaaattaaacaaacaaaaaaataaaatgtacacaggcacaacaacaggagcacagaacaaaggggaagctccatgtcttatcagttttctggactcgttccagtagcttcatatgtgtgattttgagatttgtcacagtctgagtcctaggaacaaataatacattgtccagccatgagcatgtaagaattttcttttatctccttgaatgctcttcagtttctcatgttcatcaactgattattcaactggagtgggctacaactacaattcacgagcttcttataacaaactatatctgtggaggaaaagacttgatgaccaccatctccccatctttccttctccttgaagacagagtcacaagctttcaggctccttgggaaggagagcactgataaaaaatatttctttttctctttttttttttttggaacactgattttcatcaggcaaatgaaagtaaccacagaaacaattcagtaatactactaagagagattaacttcccactggccttggaatagctaagtgcattgatttttgtgtagttgtgagtttttttctttcattgatattttacgtatttctggggtaaatgtattttttacatgcattgaatgtgtaatgatcaagtcagggtatttggggcctccatcaccttgagtgtttatcatttctatgtgtggtaacattccaagccctctcttctagctttggaatatatagtgtgttgttgctagctacggtcaccctagtctcctaaggaacattaggactgatttcttctatctaactgtaagtttgtacccattgaccgacctctcttcatttctccctgtcacccccacacccttctcaggttgtgagttggtcacctgcttaaccacagctaaattctaaaccattgtacttgcagccaaagacaacttatgcaaacatatgtctcagtcctcagaaacagaaaatacaagtcaagcaagacagtgaacctgcacggggtgtcggagccagggaacaaacttcagagtctctgacttggcagccaatggccagcgttttatttgtcagccactgaagtcagtagcttctgaagtcagggctagaagagatggagggggagggtctgggcccagcagggggtgaccgttagcctgtcagctgagccctcaatacttccaaaacagcactgtagacatcatcaatcactcccttccctgcttgtttgaaaatgaaagtgcagcagtggaccacgcatcagatctaaaaatatcaacaggaacttttccactgatgcttccttttgagaccatataaataactttagaaagctcctacccctggggctcttgcttccagcaccatacacttttcaaacagtaacagcgcccccctccagcacctgtgtccctacagaggtggcatgaggggcaggctcaggtcagctggccttgaggagaggtcagggctgggtgagaggccgggctcacagcaatgctatgtcttgtttatttatctggcaaaactgaggtactgcagaaagtatgtatagtgttttatacaatctcttcaactctccctaggagttacaatttgaaataataatttaaaaaagggatgcgaagccatattgaaaagggttagtaacaacaggttcttctgctttgggtatatgtccttggcagtgggtaaaagaatttgtaaacagcaaatatggtggaattaaagggattaggtataataataataaggcagcatcaggaagttgacagtttattttggtaccctggatcctttttaaatatacacctcacactccctatttctttctatgcaattcacatattattccatccattgctttctttcttccatcctgagggctcccatctttggtggaagcttggtgtgctggctctggtccctcttctatgccacctctgtctcttccttgtggatatagcaggtgtagagaatatcattccctattgggctcaccagcctcccaaggtgtcagctagctacgtgaataatctttgtgtcatggggccaatgtggattaaggagacaggtatattttcctgtctgttccctcccagatatgatccttcttgtttaacccaaatgaatgactttccccttacctcctggcagatgccccagaaataggcatgggagccttggggtactgcatcattcttaataaataccccatctcacatgagagatgatttttttttctagcagagagtcagtcagcttccctgaagacccatcaagctgatgagttcattaaggctcctccccattctgagattgatgcctccccctagctctgttcatcactaccatccacaatctagcaacttttctctcgacttcaagctaacctttttctgataaaacacaaaagcaactctttatgactcatatcattttaatgacaccaacagatggtgacatttcatcaataacccttctgcttataacctacggattagctcctttctccatctgccaaagtcaccaggcaggcattgccactagcaaatagcagaaaataataattgtctgtttagatgtataagctctaaacacactactgtccaatgcaaacaattaactatattgaacagcttccaaagctgcattggaggtagctgttgctagggcagaaatggactaggagaagagactatgtctcaggctgtgccaacagggctctccatggaaacttcacagcctcctgggggccaagtcctgctacagggaagtacaggaacctagaatcctggggtggatttgagaggtaccccaggagcaaggctgttggcatacattaggtgaaattatctttgccaagtaaagtctcactctggctcaatgggaggcagtttgcaagctggttagagaagtggaagaaaaaaatactgttccaagtttgaggcttattttgtctttgttcaaactggatgctccaggggagaggccactgaggttagggcagtgattttccaacttttcctagagttgtggtatgctggctttgaccttgtgacaactcacccttacctcctaaaatttctgcagagtgtccatagaaaacaaaacaaagcaaaatggtccagaaaggattcaaatggcttttgatatgagggcttaaaatagtttgatatctgctggggtctctgtagaagccttagaattgtgtaaagctttagggccttgtaatctttgatatgaaaaatctgacacaaaaacatatgactttaagttcccacatggtgggtggtggtgtgttggttgtcagaacttaaaagagtcagtgcagcatgctgggcagagtaggtggtagagaatcaggaatcctgagttccagtgtctgctcaggctgtgattccttgggtagttaccaccaacacctgcaagcagtcactaagcacctacaggtgcaaagcactgcatttaattctaggactcctgctttcaaggagtcttggatttaaaaggtgagacagaacagaagattccaaagaattactgcagtatttatccagttacagggctgctggccggttaacgtggcaagagactactgcttgtcttcccgtatctattctgcctattatggactgaattgtgttccctccaatcatgccccttccttctcccccacccaaattcatatgttgaagctgcaacccccaccagtacctcagaatgtgacttatttggagataggatcttcaaagaggtaattaagttaaaacaaggccactagtgtgggtcctaatcaaatctacctggtgtccttataggagaagattaggacacctagagagacactaggggttcctttgcacagaagaaaggccacatgaagatggggacacagcaagaaggcagcggcagcaagcaaaggagagaggcctctgaggaaaccaaccctgccaaacacctgctgcttggacttctagcgtccagaactgtggtaaagtagctttcaacaaaaagtgatacaaataaaaagcaatacagtgtaacaactatttacatagcatttacattgcattaggcattctaagcaatctagagatgatttaaaggatatgggaggatatatatttgttatatgcaaattctaccccattttatatcagggacttgagcatccatggaatttggtaaccttggggatcttggaaccagtcccccacggatagcaagggatgacagtactgcctttatgctttaacaaatggaaagcttgcttttacctaggcttggaataaagactctggttttcagccttctcggcaaggtgtggcaatgtgattaagttctggccaaaggatgtattggaagtgtccttcatacaacttcctggatctatctttaaagggtgcggatgcacccttcctccttccttcctctttcttgctggctggaggggacattttgaccacagcagaagataatcttgggccatggggtggaggaacaatatatgaggctctgagtttctgacacccatcaagggccattcgtgccctggactgcctatactgacttgagagataatcagaaactgatgactgatggcaatgcttccgggataaaggcacccacatgctgtgactgcatttgctgagcagcctgggatcactctatgaattacataggaagcaggaatctggtctctctataagatatcttattaatgcaggtcagggggccacatgttaacactagactaggtgtcaaaatgcaggacttaacactggttttcttggtgtttataggaaattctgcccaagtcatgcacccacttcacatcacaatatgttctttctcacagggataatcaaaagggcactcttaaaaaaaaaattatcttattcaagccattgttattttgggtttttagttctttacagtgcaagtttatcctaactgatctagtgttctctttatgaggactcaagggagaaacagctctcaaatctcagcactaagaaaagtcagacctcttctgagaaactgaaaaatcttagaaatactatgagtcatgtaatcgataagattctttctgtgttttgttcactggggagttcagagccaaatttgtaacctgtacccaacaatgacagtggtggatctgtgctcaccatgttgcggtcttagtactgtcatttctcatcctgggctgtattttctcaaaaccattcattttatcctttttcctcagatgtatttttgtaagtagcctcgaatcttgtgaaaaaaggtgaggcaggcgtaaataaaaaaagtaacattcttcagtggtgtaatagaaattttagtgtaactttatcaggttgaaaagacttgagagttgggcttggtggctcacacctgtaatcccagcactttgggaggccaaggcaggtggatcacttgaggtcaggagtttgagaccagcttggccaacatggtgaaaccccatctctactaaaaatacaaaaattagctaggtgtgatgacaggtgcctgtaatcccagctactcaggaggctgaggcaggagaatcacttgaacccgggaggcagaggttgcagtgaactgagatcttgccactgcactctagcctggcaacacagactccatcttggggaaaaaaaagactcaagaaagagaatatacatgttattctaagtgacaactggtaacaaattgataactgccttctaggactcttatcaataccgaacattgaaatctggaggctcggccatcagaactcttacacagcacagaagacgagtttcacgggtcactcagcatctactggaagggtaaaatcagcttgcctttatttttatctggtaaatgggaggtacagcagtagctggtccagatgctcatagcatcatgataatccatttagcttctttgcatgtacatcttacactttttccatttgaatttggtatagaagtttgcccccaaataaacatcaggtcttcggtggagaagcctgagttggattcaccagttcagaggttgcctcagaagccagaaaaatatttcttggaggcaacccggtttcttattttttgtctgtgaagggcactgagcaagattccagagtgaaggtgagcccactttaacacaatctctcctatcagagaattaaagtgaaaactcaggaggcatctgaaaataggcctaattcaagttcagttttattgactggtaataacatctcatcaccagttcacaaggagcaatctcggaggatcacccaggtttgcctaaatcccagttgaggcttgattcaggctgggagtgaagttcttacatctctcccccggctcactgtaacacttaggagtgctacctcttatcattgggaagcctgttcagtgtggaatgatgctgggtcaaaatagaatgtcagcacttacgtattttacataaaaacataattcattgactttaaaaacactagtgcctctcactgccttctaggccccaccagacgttaaacactatgttattgcaaggcagagctcatttgtctcctgggatgttttaatgtgggttaccttcctgtacaagaacttcttactcaattaatcatatggacaataatagatcacaacagacaagctgcaatcatagatgtctgcagtcatttaggagctttaggccccaagaaaaggagctccagaatttcagagtaggtaaggtcctgtccttgagaccagccccctcatttgatgggtagggaacctgagatggagtgacctgctgaacaaaagtgacagtgctaggccaaccctgagtaacccctaagtcccagcttaaggatcttcccctattccacactccccactttcctcagttctaaaaatagatatgaatgggctttacatccagttataccaggattctcagctttgttttgtaataaattaaacccattaaaataaaagctaggtatagcaaacatgaagtgtaggagttcagtcagggtggtgggaacaattgtaagaggaaattacaggaaagagaagcaaaccttcttggaaggcctgggggtgttttacaaagctttggggaagaatgagccgaaggcggtggttcttatcctggggcagagggcgagaagtaggtacaaaataatacaagggagtttatctgaatagcttgtttactcatgtctccagaaacgtgacctttaatcatccatgtgtaattaccctgtagtggtgttgactcaaagcctttgtcattaaatctgtgctgaataaatgctggcagggccagctagtcaaggcatgcagctgccacagctctgagtggcccagccccctagctgctctttcactgaatattggtgtctgagtatgttattcatccatcgtgcagcctgggtctgtgggtcagaccccagtaatgaaacatttaattgactttttttttttttatattttcttgagcctaaaactaatttctaatggtctaaatggctcacatttcttttttttttttttgagacagggtctcactctgtcacctagactagagtgctagagtgcagtggcatgatctcagctcactgtagcctccatctccctgggctcaagcaatcctcccactttagcctcccaagtagctgagactacacgtatgcaccaccatggctaatttttgtttattttttgtagagacaagatttcacttagttgcccaggctgactcaagtgatcctcctgccttggcctcccaaagtgctgggattatgggtgtgagctactgttccaggcctcacatttccttaaaaagctgataagaaacatctgaatgttgtattcttttccttttctcagagtcatataacatccacggcagcattgaaagtgaaatgaagggcagacctgggggtgtgtggagagtaggggccactgagatgccctcttctctcctttagcttactgagtaacatctccaagttcctaggtgcaaatttaaaaatgaagtgcaggtgctaagtcaccaatgaacatcaggacctcaaatataagttaggaagaaagacttgtcttttagcatctctacccaagaaaaaggtatagagatttagctcagtctgatgtagggaggaggtggcaaccaagtgcactatggccaaaatgagggcttgtgattttatgtgcacttcattgctgatggcacccctgattcccataactgtggataatcttggtctggctacttctaaaatggatatctgggggacactgtagaagatggattaagccctttataacaataaactttcctggggctaactttagcaagaactgaaataggagataattttcagacttcaacattcagtgttcaaaggccaacagagccccatgagaagaatatgcacaacaaaaacagcatcatctttaaacaaggaactatcctgcttctcttcctacctccctcctctttcattattggagcattgaaaatactctcactgacaaaggcggcatgttttatttttccaattaggtttccttggaaactggtaaaaaggtatgtgcctatatagtgagtgtgtgggaggctcctaggagaagacatcttgagagtgtcttacctaattgcagggatggttggagaagggatcgagagacaaagacccacttttcatatggttttctactaaataggaagtcaagcccaaggctgtcttaaatacccattcttttacaacatggttgttataaaattaactaggataatccaggaaggcacttacaagagtatttggcacatagtgaacactcaaacattcaaacaaatgttacttaattaaagtaaatatttagaaaaataatttcttcaaagacatgtaggagaaaaaaagcttgactaggtgaattataacatttccagcaatatgattctataattatttgatttgaaggtggaaaatgcaaaaattttgtacctccatctatccacttacccaatatttatcaagcattcattgactttagtgatatcaataatttcttattctctcaggcaatgtgaataaatagaaagcctttgtaaataagatgaaaggcaaaatttcacagcactaaggagaaaatacgattttattccagtaggcaagctttaagtagacttactatcagaaacaaagcttctaagcagggggcaagactcataatattgtgacatcttaattctgtgttttgtgcagagctgaaaacaatggtagagttggaactcttgaaggtaaaattaccaaaagtgcatagtcacactttgaaacagggaaacgctctgaaatcaacaactatttgccaaatgaaaggtgcccccccagaaacattccatagaacactctccattttgtaagtttaaatcacactacacatttcacaaaggaaatacctataaactcccacccaaaacagtggctggctcagaaatagtaagttattctcacctccattgtttcctaaacatattgcctaattagtgggatcagcatactaatgaccttccttatgtcaatggactacaaaaatagaacattatacttgaaattgaaatatgggagactgacccataaaattattcactactgggttgtggatcattttggtctcaccgacccaaacacctgacctcacaatctctaagtgacacatggaaaatgaacttttgggaccctgaaactgtagtttaggacttgccaaacaaggtgtgctgtgagtcacttccaaagcaaaccccgagttcagggatggctttcctaagggctctaaggctgaggataaagcatcatttgcttttcttctttgaaaaggtatgaaaacagggagagtctggaagaagaaaaaccgttagaccatatgatagaaaccagagagctgtattcagaaaagttcagttactcaactctgatgtcagtccctactgactgttatagactgaaagtttatgagcccgccccccacccccaattcatattcccaaactctactctctacactcctctgtattcagagatgaggcctctaatgaagtgattaaggttaaatgaggtaataagggtggggccctgatccaataggatcataagatataccagaaggcttgtgctctctctctgtctctatgtccccctctttcccctcagggtgcacatgcaccaagggaaagccacgtgaagacataatgagacagcagccatctgcaaaccaaaacggaagcccttaccagagactgaatctgccagaaccttgatcttggacttccaacccctagatctgtggcaaaataaactgttgtttaagccaccaagtctctggtatttttttctggcagccccagtaggctaatacaatgcccataaggatgtttatctttttcaaaggtctcatttttgaatagatctttttgctttgaaataaatcattgtgttcacttagtttatttttaaattgtcccttttttccactcattctttattgagccatagaaagatctctatctttgttcttttaatttctcaatgtctttgcatttgtgtgtgtgtgtgtgtgtatatatatatatatatatagagagagagagagagagagagagagagagacagagtcttactctgtcacccaggtgggagtgcagtggcatgatcttggctcactgcaacctccgcctcccaggtttgaggaattctctttcctcagcctcccgagtagctgggattacaggtgccagccaccacacctggctaatttttttttgtatttttagtagaggtgggtttttaccatgttggccaggctggtcttgaactcttgacctcaagtgatccacccaccttggcttcccaaagtgctgggattacaggcgtgagccaccacacctggcctgtatttgtattttttaaccaactaattctctctactctgttcttatcctctactttcctatcacttacctcttatccataagataagtgaaaaagaggtaagtttacgtgtttcttattggaaggcaatgccatctgaaacatttgtcttgccttctgtgtgaacatcctaaaccaacagagctaacagttaagtggaaaacagacttttttttttttttttgagatggagtcttgctctgttgcccaggctgcaatgcagtggtgtgatctcggctcactgcaacctccgcctcctgggttcaagggattttcctgcctcagcctcccgagtagctgggactacaggtgcgtgccaccacacctggctaattttttgtatttttagtagagatgggatttcacccatccaggatggtcttgacctcctgaccttgtgatccacctgcctcggcctcccaaagtgctgggattacaggcgtgagccactgctcctggccgaaaacagacttcttaaaaatgataaatcgttgcttgcctgatggtagaaaatagtatactccctttataataccatcatatggtttgttttatatatagatggaaaaaatcaagaatttggcaccctaaacacaacatgagaaggtttcactcagtaatggcctcctgaaaacaacttaatcttcttggacaagactctgaactgaaatcaaggtttcaaaatattttgttgtgagtgatgaagctgtctggacctaacttttccgagaggccaagaaaccattctgtaatcctgcaaaatggtttctgaagagtctggtgaaatgcaactgttatccctcactttgcattttgctccaacgattctgaggtgcaacttatggatgagactgatttctttccatattgctgtagtaaattggtttttgttgttttcatgggctttgtaaatcttgctgataaaatccataagtgatttgctaacataaaagctaactggagaaacataaaaaataattcaaaaatcatttcatcttatcaactggattaaaattaaaattattagaaatactaatgatagtatttctttccagagtggtaatggagtttttttcctttttattaatagcccttaatgtatcttatgggaacaattaatagacattcttcaaactccttcagaaagcccaatgacaagtggcatttttaccagcgagattctcagcgaatatataattctttgtcaatattcaaattaaggcagaaactctagagtctgatctgtatctatttcatcttttaaatgtgttgaaaggcctctgagtgcatcttaagcagttggtaaatatttttcaggtcatcacatacaggaactggaccccagtttttcctaaaaaaatatgtatgtacagatgacagaaaaaaaattgccttcagaaaatggaacccatgtgccaaggcctggtcagtaaaaaaatccctaatttttgcttgttttataatttgtcttaggttttctctgacactagtggatttcttttttaaggcagtcatagttctaatactgttcaggccttgaaaaatccaatctaggctggattatggtggctcacacttgtagtcccagcacttttggagctctgggtagaaggatcgcttgaggccaggagtttgagaccagcctgggaaacacagcaagaactatttctacaaaagattttaaaaaattaactgggcatggtggtttgcacctgtagtcctaggtacttgtgaagctgaggtgggaggatcactcaagcccagaagttggaggctgcagtgagccatgactgcaccactgtactccagcctgggtgatggtgcaagaccccaactctaaaaaaataaaaataaacagtctgatgaagagtcttttgatattcttatttctttcactattcagctttggcatctctcccccagcactgctcttgtgttctagtggtgtcagacataaatacacacacaccgcttttcaccaatgcctctacttcttgggtggcagaacctcttattatacttcactgatgttccaggagattgaaaaaccagggaaatgcaattcttgcctatttatttttaaagtttgaaaatggtggacctgactgttaccccttaattaattatttagaaaggcgactttctctttggaggttcccaaaccctgtattaaacctcaccactgctaagcacttaaatgtttgcttactaaggataatattttaggaagaaagacatcatatgaattcaggtaccgtatgcttggataatcttagaaatccctatcagagctaacattttttgaccaacatttattacgaaatcttccaaagagggtctaaaatcatagctgcaactttaaacaacagtgacgatgccaatctgtaacaaaacttctgatttttataatgaccttcctccctccctcccttacttccttttccaacaatctgtaacaaaactgttggtttttataatgacccttccttcctttcatctgtaacaaaactgttggtttttataatgacccttccttccttccttccttccttccttcctccctccctccctccctccctccctccctccctccctcctttcctttcgatggggtctcctttgtagcctaggctggagtgcactagggtgatcatggctcattgcagcctctgcctcctgggctcaagtgatcctcccacctcagactccaaagtagctagaaccacaggtgcacaccaccatgccctgctaattttttgtatttttggtagagagagtgtttttgtgatgttgcccaggctagtctcaaactcctgagctcaagtgatccacctgcctcggcctcccaaaactgggattgattacaggtgtgagccaccatgcctggccatgacatgttttttaaaatcaacctcagagaactaaatttaatagtaggaagatatttttgagcatttctctttttaaaaagagaaattaaaaaaccacactcacttccatcatgtttcccctactcattcttcacttagtgacataaaactcaaacatttttatcagcaccatgaggctttataaaagcagatcttaaaaactccactgagtttaggtaaagataacagtatggagaaataagtcagagctgaattcctaagaagagaaagagcttaatatggcaaggtaatatttgaattgtaaagtaagaataaaatcacttgcatattacacattctctgtcttcagtcatctgttatctacctacctatctctctctgtatctatctgtctatcaatcaatcacattcctaggaatgtcattttcttatataaatctgtttgcccacaggtgcatttgggaagctcttagccaaagcagggacaattctgatttccctaaggacagaaggaaatcttagaagtgaaatgaaataaaaactgcaacacataaaaagccgtctcatgctacatgaaaatgtaggacacagtttttaaaagttgaatttttagattttcgaatctaaggaatttgcaagtctctcccccttctaccctcattgtgagcgtatttaaatggttttgatgtgtcacagcagcagggattatgatgcagcaggcaggcagttttgcagtgtatgtgggccaagtgcaaatcacccatctagattggcaaaattgaaatgtaagaaaatgctgggttctgggtgggagagcatattgccttgaattgtctttcaaacctggctaaattctcaacatcactggaagcattccctttgaaaactggcacaagacagggatgtcttctctcaccactcctattcaacacagtgttggaagttctggccagggcaatcacgcaggagaaagaaataaaggtattcaattaggaaaagaggaagtcaaattgtccctgtttgcagatgacatgatgattgtatatttagaaaaccccattgtctcagcccaaaatctccttaagctgataagcaacttcagcaaagtctcaggatacaaaatcaatgtgcaaaaatcacaagcattcttatacaccaacaacagacaaacagagagccaaatcatgagtgaactcccattcacaattgcttcaaagagaataaaatacctaggaatccaacttacaagggatgtgaaggacctctgcaaggagaactacaaaccactgctcaatgaaataaaagaggatacaaacaaatggaagaacattccatgctcatgggtaggaagaatcaatattgtgaaaatggccacactgcccaaggtaatttatagattcaatgccatccccatcaagctaccaatgaataacttttttcacagaattggaaaaaactaaagttcatatggaaccaaaaaagagcccagattgccaagataatcctaagccaaaagaacaaagctggaggcatcaggctacctgacttcaaactatactacaaggctacagtaaccaaaacagcatggtactggtaccaaaacagaaatatagaccaatggaacagaacagagcccccactaataataccacacatctataaccatctgatctttgacaaacatgacaaaaacaagaaatggggaaaggattctctatttaataaatggtactgggaaaactggctcgctatatatagaaagctgaaactggatcccttccttacaccttatacaaaaattaattcaagatggattaaagacttaaatgttagacctaaaaccataaaaaccctggaagaaaacctaggcaataccattcaggacataggcatgggcaaggacttcatgtctaaaacaccaaaagcaatggcaacagaagtcaaaattgacaaatggaatcgaattaaactaaggagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcaaggatctagaactagaaataccatttgacccagccatcccattactggatatatgcccaaaggattataaatcatgctgctataaaggcacatgcacgtatgtttattgtggcactattcacaatagcaaagacttgaaaccaacccaaatgtccaccaacaatagactggattaagaaaatgtggcacatatacaccatggaatactatgcagccataaaaaaggatgagttcatgtcctttgtagggacacggatgaagctggaaacaatcattctcagcaaactatcgcaagaacaaaaaaccaaacacagcatgttctcactcataggtggaaattgaacaatgagaacacttggacacaggacggggaacatcacacaccggggcctgttgtggggtgggggaggggggatggaaagcattaggagatatatctaatgtaaatggcgagttaatggctgcggcacaccaacatggcacatgtatacatatgtaataaacctgcacgttgtgcacatgtaccctagaacttaaagtataataaaaaaaatatatatataaaagaacttaaagtataataaaaaaaataaacctagaaaagaatctggaaaaaaaaaaaagaaaatctgctttttggaaacaaaaaccaaacactttgccatcatactaaaaaacgagaagtaaaagtaaggaatatgggccgggcacggtggctcacacctgtaatcccagcactttgggaggccgaggtgggtggatcaccaggtcaggagatcaagaccttcctggctaacacaatgaaaccctgtctctactaaaaatacaaaaaattagccgggtgtggtggcgggcgcctgtagtcccagctacttgggaggctgaggcaggagaatggcgtgaacccgggaggcggagcttgcagtgagccgagatagtgccactgcactccagcctggggacagagcaagactccatctcaaaaaaaaaaaaaaaaaaaaggtaaggaatatgttcttataattttatctttcctttttaacacagcaactacaaacgtcataatgtgattaatttatataccataaaccatactaagtaaatgctagtaaatttttaaaataaccaaaaaaaaaaaaaaaatttgagaaggttgataaattctcagtggcatcccagatcagatttctcagtgttggaatcaacaacaatggatcagcagttattgggaaaagctagtgatcgctcagccatttaaaaagtcatattatttcttggttccacagaatatacaaatgaagcaaaaacttcattcctctgtgagagtattttaaaaatgctctctattgccacggtaaagactgtatggcagaaacctctcggagatgaggtgacaatgtgaaattagttcacttgtaaatagggtttttaaaacagcaggttaattacacaaggcaggctaaagtctcaggagaataacagtgtggtgtatggggctcataatttccgctaataaagtcaggatgcgcacctcactcttaacggaacttgctaaaaatacaactcaaaaggaaataaaactaacaaaatgaaaagccattgaatcatgtccatgaaactgtgcttcaggtggcctgatcatcccgcgttcacattttcctactgactctggaggcccagccctaattcaccccatcacccagactttccagcctggaaacctcagcatcatctgcagcttccttttcttgttcactttctatgaccaagtcaataccaaatcttcccaattctggctcagaaaggactctcaaatccagccttgccgttcatactgcagctcatacatggtctaccaatagacgccttgccatctgggctattcaatagccattaaaaatgttactcagtactgctaataatagcatacacctaagcagtgcttataatgtgccaagaatggttctaagagcatttatcctcacaacagtgctatgagatagaaaccattattatccctgtttcacaaagagggaaaatggataacaggttaagtcacttttccagggtcacacagctggtaagcagcagagctaggatttgaattcaggtggtccatcctcagagtctgtgtgatagtgaccaaagcacattgctcctgtattcatttaacccattattatttttagtgttgctgcattttttttggaaaaggtaatgcaattgcctggttcaacattgaaaagttatagaagggtgcatattaaaaagcttcctttccatcccagtttcctaccgccccagcccctgttctggaagtaagtaacatgactagttatttgacagcattccaagcaaatgtttatatgctatttcccttctccccctttctttccgtgtacaaatatactggatacaatttggcatgttgcttttttcactaaacaacatgtattggaggtcattccatagcagtacatgaagagcttctcattccttttcttttcctttctttctgttttttaagacagatggttgaaactaaggatgggcaaacgttttctgtaaagggccagatagtaaatattttaggctttgaggtccatatggtctctgtcacatatgctgctattgcttcctgtttaaaaaaagctttagaaatgtaaaaacccattcttgtctcatgggtcgtacagaaacaggctgcaggccagatttggcctgtggaccacagtgtgccaatcctggaaccacaggttcttacctcacctccctttgtctagtaattttctattctgatccctcttgaccattctaagagaattgtctttctataaaacaaatctgacactgccactgctccctctaaatcttctgcagcttcccactcccaagaggagggtgaagtccagactggttggcagtgcgcacaatgtccttcatgatccacatacttctcctcccctccacgtctatcacaccagtacgtgtcatcatcagctctttccctcaaggcctgcaacaacctctttgccccactattgccataaaccctccttccctcaaatgcaacctctaagacaccgtggcgccagggatcttttacaagtgcaaatcacatctgctgacttccaatggcttcttgctgccccagacagaagtcagctaccctatcatgatctacaagacctaccagctctgcttggccctcctctctgacttcattgctaccatgcttcctccttccactcctctctctccagccatactgatttttctgtttctgaaacaagctgagtttatttctgcctttgtgggtgctgttcctttggctggctccttcttgaacttcagtctcagttcaaatgccatttccttggaggccttccctcatctcccaactcacaggagcctctccattttccttccatcctatcacactgctttgttttgttcatggcctttggggccatgtataatcatgttgggttgtgtttacattctctgctttgctagaacacatgggcatctccagtgcccagtacattgtctgacacatattaggtaaacaatcaaaattttctgattagataaacaatggaagaaatttgagccaacttaccttttctagtggatatctccttactcctcaccttgtattttaggctccagttctatcctctttctctccaatcactaaacatgactttcccttttaaggttttacacctttgcacatgttgtcattttggttatttcttcattctttgagggacaaactccgactcacccatcaacacccagcttgaatgttgcctcttctatggagtttttacatctcctctatttaggaccaacttcttcctttggcaggctctcagagcactttgtatagaactctaagatcataccaggtcataattatttacctaacacaaacgttcactcattatttataccctgaatactccccaaatattatatacataaaaccatttcactttacatacaatgagctctttcaaggaaaggacacctcgaatggtgttttaatgataaatatgaatacataatatcaatatttagcatctaactctgtaataagggctttatgtacattatttcatttaacccttatgatagctgcaatgaagcaagtactgttgctatctgcacttcacagatgaggcaactaaattaaagctcagggaagctaggtaacttgaccctggtggatctagaattcactaccaggctgtcctacagtgggccatggtgacctgcaggcccaggtcacctgattgctcttgaggtccaggtcatctgattgtaagtgaagacctgattgctcttgaactctgagcctagcagggtggtgcacaaatctgtcctgttcccctttgtggagacctagggccacagctctgctcagagaggggtcatctgggactcttttgctcccctgcagcaaggtcctcccttgcaggggcacagatgtccctctgtcagccagatggagaggcatggggatgaggctgccctctgcacacctatgactgtgccatccccaagggcagccagatgtccttggggcctgcctcctgctgccacacgctgcttatccatgtggacataagctgctctgccagctcactcttgagctaatgcaaagggaccacagggctctgggcaggaaggtaaggagcatagaaggcagaggagacaagggcagaaggagtggcaggctccttattctttctgttaaatgaagaaactttccttaggaaagaaatacgtaatttctatcagagaataagggtaacaggcaacaattagcattttttttttcttaagaagtggctgctaggttatattgactgtagtctggtttctatttgcaggcactgtatcacttttcagctcattgggggaagttctgtctagagagtgctttcaaactttagggtagtgctactccaagtatggtccttggaccaacagcatcagcatcactggggagctcattagaactgcagactctaggcctcatggcagacctgacaaattcagaatgtgaattttaagatgacctccccagagaatttgtaagtacattaaagtttgagaaacactgagctaggtaaaatgcaagttttaaaatgcctaattaacatgcaagtttggggctccaggtcttagaaattctgattcgcctgatcaggatgagatccagaaatctaacaagcaccaaaggtggttctgcctacattttgagcaactgtgttctagagagagtggtggaaattgtacagttggacggtcctgagatgaaatctcagctctaccatctacaaactaggtaaccccaattaactacttcatctcactgagcttcagtttcctcaactataaaatggagctactatccgggcgcagtggctcacgcctataatcccagcactttgggaggccaaggcgagtggatcacctgaggtcagaagttcgagaccagcctgatcaactgaaaccccatctctactaaaaatgcaaaaaaaaaaaattagccgggtgtggtggtgcgagctactcaggaggctgaggcaggagaattgcttgaacccaggaggtggaggttgcagtgagctgagattgagtcactgcactccaggctgggtgacagagtgagagtccgtctcaaaaaaaaaaaaaaaaaaaaaaatggagctactaatgcctacaccttcagctgtgaggttaaaggtgataacatatgttgatatggtttggctctgtgtccccacccaaatctcatctcaaattgtaatccccatatgttgcggggaggagcctggtgggaggtgattgaatctggggggcagatttcccctttgctattctcgtgatactgagtgggttctcatgagatctggctgcttgaaagtgtatggcacatctccattccctctttttctttcctgctctgccatggtaagacatgcttgcttccccttcaccttctgccatgattataagtttcctgaggcctctcagtcatgcttcctgttgagcctgtggaactataagtcaattaaacctcttttcttcataagttctctatagcagtgtgaaaatggactaatacctatgtaaaatgcctagtaccgaagctgtggcaaatagtaggtgtttgataaatgttaggttttacaactactagactgaaaagttcaagtggttgtgccattgaataatgggttgggccagagagtgttaatttcaaccacagggacagagaaagccaaagggggctcactgagtctgatggctgtggtttctctattacttaacacagaccttaaagacacagagaaaggattaaactgcagcaggtatcaagctttatcatacattaaaaatcaccttggatgctaattaaaaatgctaattccgacgtgctgcttcccagtgatcctgtttcaccacacctggtatatggcccagggatctacattttcatccccaggagatactgatgcatgagtccttcaacctcacctggagaaacagtggcttagagaatattcatattcattcaataaatgtagaggctgctgcatgtgggaccctggggtggcactgggaaatacacacaaggatgtataaggccctacctgattcctgcccagctgagagctggggcttccaaggagaatatagggtctgtgctgccacgctaggatatcagttaagaacaacagcccagaagagcaatggagaaaagccatacctgggcttctgcaccttcaatgttgtgggagagatttccattttgtacaggttctgaagcatcactggatggtgtcatttcaacatctgtgctggtgctgtttggaagctcaattttttctgtgatataatttaaacacacacacacacacacacacacacacacacacacacacacacagagagagagagagagagagagagaaagcaaatggaatcaatgggggtaaagagcaatattgaaaagagtttcctaaaatgttgggctaaagcagaggatagtggtgtcccaggggcgataaggcccagggctgatattgagccaagcgggaaaggatttttaccgttcttccccatgtctttcagtatacggcctgcccccttaatagcgccctggcttcctgctctggcatgacactttaccttgggtgccctatcagctcccatgatatgcctttcttgagcctaggcaaatttaccaactagctactcaggaaacatgaacatagacattttaaaaccaaaaccacacgcaatctacatactattgtttacaccctggactgtacccttcagatattttcttacagtaatatcgtttctttgatactgtactctggaaaggatattagctagggcttcagggtcctagactttaccctgctttgatcgggttgctatcttaggctagttcccttcttcctctgggacttgggaatcttatctgtgaaataagagggttcgacaggttgacctccaagggacattatgttcagctgtaattcagactctgtgagtggaaactcttccagtgcctaggtggccatgggcagggcagcctggtgaatacaacttagcacactccacacctgagcatcctactgcaggcaaggcaagggggagctcgacaagtaatagaggccaaaggctgtgtcattcctgaatcagaacatttagctagagtaaagccagagggtcagcaagtgcagatttgacacttgagaagtgactctagggtaatggttaagcactgggagtctgtaacactgggaatcagacaggcctggcttcatattctggatctacaacttgtgctgtttcaccctttgcaagtgactcaacctctctgaaattcagcttcttcatctgtaaaactggggtgatggtaacaatactactactactattactgttgctactactaccactaacaacaacaatatgatcaaagagtatttctgtaaagattaaataagaaaatgcatataaaacactgtagcatagtgccttgtacagagcaaccaagaagcataaactatttggatctttattatagtgcctgcctttcactagaataattttttttttgtcatgacaaagaggagtaccatcaggtgatcaatgttccagcaccactgaggtctgctgaacttcatcgcgagggaaattaaaaggttcctattgaaagcacacactctggctgttttgggtcaaatcatggattttgggatggaatgaggctgtagtatgctgtcagggtttctgggggtatcagaatgctcatcattgtcagatccgagcagtatcagctgctcatcaaacataagaatgtgctttttttttcctagcaacttcagagggactagacatttccatcactggtgcttaagaaaataatttgagagttacataaaaattgtggagtttgaagcagccaaattttggaaatcatagggaaatatttatgtttatttatgtatttagttgtggaatatagacacatgaatagatttaaatacggaaaaccatagaaactcaaatttactttatctttccaagtttttagtagtgacagcgatacgtatgtgatgtgctgcatgtggctatgccagtttatcttagtatgcttgattcagttatttaaataaaaaatcatgaagaaccttgggtgaataaaactctgtttggagaattctattggctgatgtgataaaaccttaggattagcctgcaatggtcaaattgaccctagcaacacaaaatactgggtaaaaggggagttaacatgtccaagaacagagatgaacagatgagcagagactgcctgccaggcataatatctaacctgtgtgtgcacatcttagcttataaagtgcttttacacagcaggctgaaggttcataataaaagaaaatatgaaaataaatcttggacttactttgaaaagcattagctagttacaaagtcattcagagacccaataacattttctagttcaaagtcattgagagccccaataacattagaagaatccttggcattaagtgtcctacctccttaaaaaagattaaatccaagtctaaggttggccagtcattaggaggaggaggactgcgactgagcccaggaatctaattcttttactccaagctacctcattctataaaagacaagtcaacatgtgaagcagaaaaaatagcttgtgtagttgaatctaaacatcacaaacaaaactcaacctatgcggtagactttcatggtgtggctttacatttttatagtacaaaaccaaaatatgcttattctgaaaaactttatagaagcataaagaagcagaaaaatatatatataactcataatcccagctttaggaagtaactattgttaacattttagctgacttctttccagtttttcttttcgtatctaattgcatcttaactgtttctcagccaaaaattttccctgaggtagaagttgggataacaggaaaggcagaaactcttctacggagtgtcagtattttgagagcaatgctgttgaattttgtctgcagataattttagttacttgggtaatagcttcgtttatagcatagatccagatcaggttaaatttagtttgaatttagaataagagagctatattatagttacagacaggagagaaggaacatcatgttccattttaaaataagatgcctgaatgtcacaatcttgtcatacaggagctctgcaaaagtcagtggaaagagacctgggggctgttactgctgaattcttaaaaacgagaggcagcatcatctcaaaaggactctgtcactcagttcaggagtgaccaagtgtgtgccataagcaatatcacaggtataaaaatctggttaccagtcaagacttacagaaaggggactctcacctttgattaaacattaaatgacactgtgtacgtgtgcgtgtatgcgtgtgcatgtatcctgtttatgtggaatccctgaaatacagtgattttctattcttgaatggagatgactagttaagagatggttttacttcaggttcctcagagaataaatttactcttcttggacttctagagttactggtgacatactgtgtccatgcataccctgtacacactagggcaagagggactcatttcctgttgcacagggaagggctgtgctgcagcggtgtgtgtgtctgcactgagtcaggggtgcccacactggtcctgactctctgctcccctcgcttcccccaggaaaggtatggggtggatgtttccctgcactcacccacgtggttggcagccccattctgcctctcgttctcatccacatgacatttcttcttggcgatcttgtggagaattgaagccttttctctgaacctccctgaagcaaaagaaagtggcaggaaggagacacaatgagaaagaagagagtctcagggccaagcaggtatgtggcctcctcagtcacgctgcactaatagcgtgaccactccattctgtccaaccccaatgcaccaggaccttcctgaagggtactttcttgcctttgtagatttttcagcccaattctctatttgagaatctcttccctcccttcccagttgctcacaaaattaacaaaagcaccaagcaacactaaagcttccctactgctgagatccaaaacaggtctagagaaacagagctgctctggaggcatggccatttctctgaaattaaatgctcattccagaccagattttgacaatgggctgggaaggaaagccaagcccaggggtcctctgatttgacttcagttttcaaacatttacactttgagtatccctaactgaaaaaaccaaaatctgaaatctgaaacacttctggtcccaagcgtttcagataggggatactcaacctgtcttataattaacattgctgtttctaaacgagtaaggaacatgcatcacagctttccaaattagctgagtcagctgcaattaaggcattaagaaggcaactgattccatttgtggatttagggcaaggaaggatcaactgagtgcagcaagtaatgttggtgatgagatgctttgggaatggtgctggacatgcatatttatagcagcacaattcacagttgcaaagtggtggaactaacccaaatggccatcaatcaacgagtggataaagaaactgttatatatatattatatatagttatatatataaaatatatatataaaaatattccaacatatatatatgatggaatactatgcagccataaaaaggaatgaattaacagcatttgcagtgatctgaatgagattggagactcttattctaagtgatgtaactcaggaatggaaaatcaaacatcgtgtgttctcactgatacatgggagctaagctatgaggatgcaaaggcataagaataatacaatagactttggggacttggggggaagagtgggagggggacgagggataaaggactacaaatatggtgcagtgtacatatggttgatgggtacaccaaaatctcacaaatcaccactaaagaaattactcatgtaaccaaataccacctgtaccccaataacttatggaaacataaaaaaagttactagaaaattgccattctcaaagtaatcattttaaacagctgtaacacaagtgcgatgtttcatttcttctttattattgacataataagtaaatgcatgcaataagccaaaaaaaaaaaaaaaaaagcaagcaaaagtgcagagattagggaaacagcacattcctcttctttttatcctttattttcttccttgggaacattcaaggtataaaaaaattctcattttaaactgattattgcctagattcagatataatgagtatctcaaaacaccacaacccctacagttttcccacgatgtattttttttttttccggcttgtgttctctagcagcatattaacaggggatctcattctacttttttatttagaaccaaaccaaacaaatatgtttctcctggagagcttcttttcctaggataaagcatggcagattggcacccactgcccacctccatggtttggaatcatggcgtgtggtcatggtgatgacttgtgtgactggctgggagtgacagcacctgtaaactagagtcagaccaatggactccaatggtgaaaatgacacgagctgtgaccctttctgctcacggctccattagtcacaagcctggtctctttgccacaacaaaggcaaaggcaatctctaggccataagtaccttagtctaggcaatgaatgtgcaccactgagtacactctcaaaagaagtaggaaaggaaatatttcatggagaaaaggaggttggtgtgtggcttgggcttcctaaggagtgagaaagaaggatgaggtgataggcacgactccatccatgaggaatgttgaaggtcagcattagattcaccaccctggaaggtagcttgaatttggttgtttctatttaatttccaagggaaactctgggaagaaaaagggaaaagaaatcctggagactaggaaaaggaggtggtaaagaagaacaagaacagaaaggaaaaatagagaaaaagaaatgcaaggatggaggaggcaggcagggtctatgattgcctgaaggttttccaggctgtgtggatgcaagatactttcctggctgccaaacctagtcttatttgaggactagataaacagataataagagtgagcttgagtactctgcagtcctcagcctaaagaggagttactttttgcagaaggcaattccaaaaagtcccaaatcatctggttttccacccagaagaggaaaaaaggaggttctgaaactttattggagatgatgcttcttctaataaaatcatcccatcatggtctcagggttattgtttgaactcagaacatcctgccactctaagaaatatagatgatcaatatttgctattggaaaattatctgtaagataataataaagcaggaaagcattcagaagcggcaacaaataggtctgtggaaataaaacctaaaataactcaactcaaataatgtcctaaagtcatgaatcatgacacagaaaatattggatagaaacaagctaatgacatatcacttgtggttataagaatcttttcagagtttaggtgtgtgccagagagaaatggtaataaaagggacccaaaagcctggaaggggagccatgccctctgccaggaagcatctttcagaatagtgttggccactggcactcatgggctggttttccccaaatctccaaggaaaatctaggagaacagggtaggagataaccctagaattggaattttataggttctcaaatatcttacaggccagtgagactgcatgttactcttttcccactgcagcagcacctcaggttttctgtgctattgaacagtaagagggattagcgttatttgtgtcctcttgctgccttaggggcagcaagccaaagcagcaaggctgcttgggagctgtcttctccacagacctcttcaacttctgcaactcaacctccctcctagatgattctttgtcgcaactaatatgacctggcagccattccacatcctaagcgctgacaatggctgcgccataggctagaaggattttccgttaaagattagtttctagaaaggctgcagttgagggcccaccttcagaatgtggcacacatgtgtaatccttcagggtggtggggcagagcctgacaaaccagattcgctgattccagcccactggatacgcctgagatcatcacagggcaccttttgagaaatgctgtgaggatgaggctaacaggatatatgtgagcgtgaaggacctggggcagaagccagcagagaacctgtgatttttgaagtgatcctctctgccttggggtaggaagacatggcattttcaggatctgttcattcccaagtcacaaactgtgaagaacagcaaacaaggtgtgtgtgtcgggacagcacaatttcatgcttaaatggaggttaaatggatgtgattgagaggtaggtagatctgagttcaagccctagctctctcactgtctctgctgggcgatttgtggtgagtttctacatatttctgtgctttagttttcccatctgttaagtagggattccagtggtattggctgatctgttaagcagggattccagtggtattggtagagttactagtgacatacgatgtccatacatgtcctgtactcacttggggaagaggggctcattttctgcctgtcatccagggaagggctgagctgcaggggtcttctgtgagaaaatatgtgtaaagggcttatcacattgtgtggcattgaaagaactctgtaagttagaggaaaaagagaatcaaacagaatctaagggtgatgtagtcctgagttgctgtaggagaattgttgccatcctctcttctctcaatccacacaggccgagctggagaatcagccacattcagacccaggagtttaagcatacagggccttgttggactggtgttcaagtttcagtgaatcccccaacacttgattagaaaaaggatcattttagatctttctgcaattgagaaggtcaaggtgatagagctggctttctgggcttaaaagttgatacctctgcaatcttaaaatggggacatgatgatcagctttccctcatcacctgcaggtccaaaattcagaccaagggactactgctgcagcaaaatggatttgctcaaaagaacctcatgaagcaccaggttcttaacccctctccacctcaggcccagaataagtaagatggagctaagaagagcatccagctaaaacagtccttggaaggtccaatgggttaatacccattgcatgtttcaatggcctctgataaacagcaagtgcttaggaactgctattcagaaagggttgctatcattatggaagtagatgacaggaaattcttctcctaaattactgaaaagaagattgatatttaaaatagaattgatgcctagcacctgcaggtgcagaccttggtggtaaagggattgctcagatatttcaggcacagattccaaattgccataaagggtggcatagaggaacgaatctaagaaatgactgtgtaacattgagcctgccaaaaatgaattatgatatttttgagtacttttcaaggtgagtgaaggagttatttttaacatgtttcaaggcaactttaaaaaatatactctcttgtggtctcttgtggtctaaacccttaaagtgttgtatttttacatagctacagatatttgtatagttaaaaatctcagaaatagcaaactgctcaaatcgtgaggcacctacgtcaaaacctagtatataattttaatatagtttagcttggtctgaaatttgcaaaagagtaccagctgagtgtcctcagaggagtgtatgttgagggggtggtagggaagtgcggaagtaaaagatccaagcataagagctgaatgtgaatttcgaaaaacaaccagcaatcaaaatccttgaccagatcattctgacataaaacagaagcttcatgctgcatggaaaaacaacgtttggagggtctgttcactcaaaggaaatgaattttgtttctcttctgctgttaattaaaacagccccttggaaattccctccctcccatctttcccaccaagtctataataggcagggttactggggtggtgatcagattaacttccagctgctacagaacattctaagcatctgcaacacagaaacaacgatgggacaaaagagagaaaaagatgcaaagagagtggccaaacacagctcggtgaacagaccatggcttgggagaagaaaggaaaaaataacacaggaggaaaaactagaaatcagccttttaaaatctatttttgtgttttcggttctgcctttcttgtctctttctttgaagtttatggcttgccaggtagcttaaaaagcaaaagtgtgtctgaactttcctcccatttattcctttccttttttttctggaagcagagacttaagttaggcatagacttcagttaagccttcatcactctcagaaggcttgcaacagaactggtgtggcatcatgaagttatcctgggctcccctgtttctctcacaccccacatgccatctaccagcaaatctggtgtctctatttttaaaatttttcagaatctgaccactttttccttccacccctttcccactccccactccgcacacccacccaaccagcaccaagtcacataggaataattctgctggtctgagtctcccccttctaccctcccctctccgccccagccagtctcatcccagcatctttagtgatcagtaaaacagaacatggcacttacttctctgcaaaatcctgcagtgggtccctaggtcaaagtgaaagccaaagtcttactgattctgtgcagtgaaactcatcctgactgccctgatcttgtacgctacccctctcctctctcactgctccagccacgctggtctctttgctgtttcttgaaaacgctgtgcacaatctcacctctgtgccatggcattgtctggcccctctacctggagtattcttcccccagaggtccacagagcttgttcaaatgtcacctcattgaggcttgtctgagcagcctattgaaatctatagcttctctctccagcatttcttatcccaggtttattttctctaaagtagttatcaccgtctaatatactatatcattatgactacagattatttggtgctttccactggcagcagacaagcttcaaaagggcaaggtttttcactggttttgttcactggtatatctccagtatcagattgggtgcaacaaatccttgtgttcatggtttctaggcaagtagatgaggttatgactctgtgatgtgcttcctgtacgccaatgacccagagtaaatgtctttaggacctccaagcccatggccccagtggaactgagtgtctacctatggggccccaggaactttctagaggtaagtaggagaaaaatggggtgtaccaggtgtttatactccagtggtggaaggcaggggagacacatcagttgtccccctctgcacatctccaaggtcaataaggtgcatgtgcaaaggagccctttccataggacagaaggttaggtgaacaccataaagatcagggcagggaaagctgggccttggctcctcattttttttattaagctgcccctcattcatcaaggcctaactcaatgtccaacctgaaggtttctctgcacacacccctcttttcgaagtggaaacccaacattctcatggcactttgattgtacatgttacagtccttatttcagcttgctgcccacatgcctgctttccccagcagagagcagtcttctctgggagagggatcttccctctgccatctttagtatcccttgacaagtgtcctataatcatgcctcacccatcacaggcctacactgtcttgcagtgaagctctcactatgatcagctcctctgggaagtcaagcttcctttcaagttagtacaagtcacaaactaacacatagcaaatagtaaaaaaaaaaaaaaaaaaaacaaacaaaaaacaaaacaaaacaaacaaacaaaaaacaaaaaaccgtgctatgtactgggctgtatttggtgaataagacagatctggctggttcccttgtagagtccatagcctgaagtgaggaagagacttcatatttgtgctctgatggatggtggaggccttcttacgagggtatggaggcccagagaataagagtgaaagttcctccacaagagatgccacctagcaactagaagaaacaaatcctcttttattctaccaactatcttactggaacagttaatttacctaatagaggcaggcttaatttttattcttaaaagcaaaaattttttttttaattattgtaagttttagggtacatgtgcacattgtgcaggttagttacatatgtatacatgtgccatgaaaattttaaagaaatttttatttcttaaaaataataatttcatcttaaacaaaaccaccaaaaacagaattttatttattcccaaatctgtctttgaagtacaacctctaaattatttttttctaatttttgtgaagcatgatgcaaactacttattacagggctacactgatattagtaaaaattaaattactctgtaataaagtattttgtaaagtgtctttagtaaatattttgttaatgaaccacataatagagatgattaacgacatttaattatattagatttacagacacaatcataggagtaatttctgtaattaatgagaatatatacataattatatctcaagtggtgaccaaacccattatacaatgaaatgaggcagcggaatttccttattaagaactttttctccccacttatgtctgcttagcataaaaaaagactttttttcctcatttcctctacactcattaattggaattctgaaagtaacacctgtcttgtctctcttacttagtattcaattatttatttacatagtataaatgtgtgcatatttcttttattctgtgggcccattatttattcagttaattaaattgtttcaatcttgaccactgggatatttttcagattggcttctgtgttcagtcaacaagcttcatccttttcaaagcatttctttattttctggcatcacaagatgtttcaatatcattttgtatgtttcctggttcagcacttggaagtaatcagttctccagaagcaatgactccttttattggaaaatggtatttagaaaccaagatctgagaactatgtgtgcttatggctactaagatgtcattgctcctagcctttcttagtggacagagctaagaaagatatgcatgtatactgaatcatgcatatctacatctacatttatctctgtagctatagctgtctttatctgtttatgacttttggactttaattgtaatagaagtaactaacatgtttttctagcagctttgccctccagttccatttaaacatttgctccatttgagagccatcctgatgcaaagggtaaatgacaaatccaatgctgtcttttcatatggttacccacgtgtgcccattcaggctttctttaataatgttctataagaatgacctttgtggccacccataaaggatggatcagcccaaatgtgaatttgttctaccatctttcctagcagggtcaccttatcgttagaaatatgaacgtgcttttgtaattggtctcccagttttcaattgcatctcctgcatcctcctgatttactcttcacaaggcttggaattctccacacttcttatctgtcttatttctttttaagaaacttaaggaatttgtcttattccttttcaagactctgctttaggcatctcatccttctggaagccttccctgagtccctctcccccatcatagcacctgatacctatcctatcacggcacttgtcatagagcctcagaagtgtttcactgacgctctccccaactagcctgtggggctgttaaggataaggatgctgttctccatctgtgccctcaatgctcactgcctaggctggtcctcacaagtgtttgtgagtatagcaacattaacacaaacaacaaagaatatgacattgggggctgtgggtgtgagaaagtgctcagatttttcgctatatgaaatgatattctgtgcttaccttcctttttaggggtacagaaggaagaaaagcctagaaacacattgcgggaaacttgccagactttctgcttgattaatgctgtggttaagttaagtttccaaagactaatagtgtttataattaatgtttattttaataccccctccctttttttataaaaagataatctaattgagttcagatgtaattggcattttacaaaccaaaaaaactcccagcaggtatcagactgcagaatatgatgtttcaggaaaagggccaacttactgatcgtggccgtttctgacagtgcttgagagctgatgttctttatcattttagatcacctgcttcattgttttaggaacttaatcttttgaacatttcaatctcatatatacagatacaaatggctcacacaaagaaattctcagaggtttgccttattctcagatttgatttctgagccaggtagagactgctagacagaagctttaaatgtcttcttttgttcccatccctggaactctgaatgtctaagaggtaaacgaatgaagaatcactttactaaaaaggcaggccacatatcctaagacctgccagcatttaacccaactacctcctaatgggcataaaaattctcttcagagttgttttgtcaaagcccatattttgggtatgtgtctctgcaagtgggttgtgacattattcatttggggagagctttgatctgatttaccgtatctggaaaatagtaggtgctcaagaaataggtgttgaaagattatgatgacctatatataaaaaacagaatcaaacaaaataattctttcttttgaggaacctatatattacccaatcatttattttattgtaaagtggaagattttatatttggctaacatgtattcagtagttgcccctattttgtgaacttatagcatgtattgtcccctgggtttcatatgtctatgaattttcacttaatctgagttcttagtttatattttaattttagtcctcaactttacattgtaatctggtacctgtaaatctcatgtgaaacgtgggttagcagcagaagcactggcacatgctgagagtccttaactaaaggcttagaggcctatgactaaaatgagatgattaggtttacttcagatctaatcaaaagagaaacttaccatgcctaattgaacatgccagcctccaagtataacaaattcccacctttttttttttaaagagcttcatggttgaggggaatcatattattaatttataataacagattcaagtttgactgacgaaggcaacttaaatcttcatctctagagatgtcagtaacacacaaaaagaagcatccacaatttgccttctgctgccatttaacaccttctacatatgcaatgtgacaaaatctgcctttctttgccaagtccaatctttctgcttttactgctgacagtttagatcatgaaaataagatgcaatgaagtttgaaaagctggatgtattctaattagaagaattccttggtcctggttttcaggaagactgtggctttacccacatagctggtttggtctttctaacagacctgatgctggttgctagctggttagcctggttatgcacacagactagcctgctgtcttcctaagatccagccccagggagatgcttataagaatacatctctgaagcagtaatgtggctagtactggttcaatacagttttttttctttttttcttttttttttttttttctggataaggcccagccttacagagaacatctattcaagtgcccagaaaaatcctctggttatgaaagtttgaactgtatgagttaagccataaacttgggatgaatgaaagatagcacgatattggaaatggtgtctgtgcacagtaggggctctctgctttggtaattgcaaggtagaaagtcaacttgcagtgtgcttctcagactttctgtagggatagcaatgatcttgaggtatgaagggcacacactgcagtggaaattggagattctgtgtaggaaatcggccttgtcatttaatttagagaggtcaaatacctctaccataactgcactctgtatttaactcaactctggtaaaaactcaggtttctaaaacaagtaaattagaaggtagttgttatattacaaaggcttatgtgctttgtaatgaagccaatctgagtctctcttcaaaggacttatttaaatttgccatctgaggccccgcgtggtggctcatgcctgtaatcctagcacattgggaggctgagtcaggtggatcacttgaggtcagggattcaagacgagcctggtcaacacggtgaaaccccgtctctactaaaaatacaaaaattagccaagcatggtggcgcctgcctgtaatcccagctacctgggaggctgaggcaggagaatcgctggaacctgggaggcggaggtggcagtaagccaagattgcgctactgcactccagcctgggtgacagagtgagactctgtctccaaaaaaaaatttgctgtctgaggctctgcaattcattgttagtgtgagcataaattggtgcaattgttttggagggcaatttgacaaatatctttcaaattttgaaatgtgtatactctttgatctggcatttctatcttcagaaatttattttatatgtatatgtcttctactcagtagaatttgctcaatggccaaagaggatattcatgtagcattgttgtaataactaaataaatcaacaaggaatgaaaatatcctaaatgttcaacagggtactgattgaaccaaccatggaacagccatgcagtgaaatactaagcagttgttaaaatgaacgaagaaagtctaaatgtgctgatgtggaaagatctccaagatgcaattaataacaaaagccaggttagaaaagaaactgataaaagtggtcatctctagggaatggatggaatctggggtaggaaagagattcactcttattgtctttccttatgtagtgtttgcttttttacttatgtgtgcatgtaatgtttttataacaaaaaatagttaaaattaatccatgatttaagatttctactgtggtaaacgtttggatttgtaaccaaaagggaatatatattttttcatcattttaaaggtctgtttcacttatgtaatacacattaggaactatctaatgtactatttgctatatttaaccatattaataaagactttggatatgaactagatcaaataatatacaagccttttatttcagatgctgtgacctaggaacctacctaccatagtcttggtggcagcttactcaaaatgcaagatcaagttttcatagggtttaagtagactgcagatcaatgtctatcattacacttgatacagaatcttgagcattgcaaaagaaggggcatcaaagcatccattatctgaacactctttgggtggaggcttccctggcttctctagacaaagagactcactcccttctgaggcaggccattccatctttggatatgtctgtaggagaggccttcctatgctgggctgaactctctttctctgaatttaggaaggctgatgtgctttcctgaccagctagacttaagagggtccccaaaactcccctctcctggaaagacagaccctactttaccatggcaaactgcccatgggaccaatttgaagaaagaggctgtggtaacaactaacttctaaaacattttcaaattgtttcctaactacatgctacatcctcgttcactttagcagagcttccacgtcattcatcaacttccagaccctcatatccagatggccctgaatgtccccaatctgactcaatctcccactcctgccaacagtaaatctcctagatccttcaccttttttttctgaaaattctctttgtcttcttgctcctactgaaacttgactatttcctgaaggccccttttcttctgcagcccttgaaaagtggcagctgcctgctcctccaaacaccctgctctccatcctgcccttccttattacttctagcccacttttcctccctccttgggagtacaaagcaataaccaccccttctacccaagcggacttcctggtctccctccattcattcctgaagatcgtagaacctagcttattattttcctctctgtccttacttctgttcccatctgtgatgactttttttaggtgagccctgcaacacctggctccttaccttagtgccttcacctactcactcccagctcgttttgtcctcattcacccactcctgtggtaagcctacacctcatcactagcaataactgcaccacttccaaaaccccaatttgatattaagtttttggcaagtcaaaaaacccccaatttgaagcatcccactttctgtccaccactcacttttctctttctactacaagaaagtagtagatgttctttgatcttactggtcaattcattgatgcggtcaccttttcactgccctcctttaacgtgttcttcactcggctccagagacaccattctatcctagttttcttcccacctcagtctcctttgctgggcctccccttttttcccggactctagactttggagtccccagggctcaattcttggccttctcttctctatcaattagctaggtattatagtccagttctgtagcttttaaataacacgcatattttatgacccccaaatttacatctacagctctgcctgacctctatcccatgctccatactcctacacccaccactttctcaacatctccatttggatgtctcataggcatcttaaatttaacatgagtgctcaagctccctcttatagcttgctctattctcagtcttctccaccaacacacagttatatgaaagtgagatgtccctgttgagaagagactgcaagttgcctatccaatatctattccattttcatttcctaatgacataatgcctaaattattggggacagcaattcatgcagtttaacaaactacatttccaaattgccttgaaactaggtagtcatgtgactgagttttgagcaaattttactgagagggtcttcagggaaagctccttaaaaagaagacaaaatatctagagaaaatcactttgacccttcctccttccaagaatacagacgtgatggccagagctcaacagccaccatcttggaccatgaggtgcccttgaggttacaaatcatatacgagggtggtggagcagaaggatggaaggagcctgggtcttgaattattgtggagctgctagagctgccatgtcttgtctgctactcgaattcttacacttgagagaaaaataaacttccatcttatttaagtcactgttaatttggattttctgctatatatagctaaagctattttgcctgatgtatcagtgtgtatgacacaatctcatcctttcatgcaaggattacaatgtcctatgaaggtcacagataacaagaaggacttattttaaagtaacattatttagttgatatatcctgggcaatgaaaaacattgctgaatggtattccaaaacttaatttctctttgaaaataattagactatttcactgcaactaagaacatcaaatgattggctagacaatgtgaccttaagatacttttgtttctttgaaataatgggggttttcaaaacagccacatgcctaatttaggaccccatgattcatgtaagacattattagtttttcagcttggtaaaggggcagttggttgccatgaaacagtaagcttaatttaattatggaaaaggtctttataatttttttgcccttgatatcacaacttttctaccattttctcccttatacaaatgaacaaggattgactttttaaatagtggtgaaattatttttctggaaatgtctttggttaaatggcagagagtttaggacaatacaatggagacagctttccccacatattgcttcattgcaagatattagttgggatatctaccgacctacctacctacctacccacctacctacctacctacctacctacctacctacctacctacctacctatctacctatctacctacatgtctctgtgaaacatttacctttgaagagcaaaaattactaattctatatactgccattggtggaaaggtcttttctccttttaatccatctgtcccatcacacaaacttgcctacttttgaactagcattctatattattattcagaataattttaggaaaagagccacgttcaatttattgagaattttctagagtaagaatggtatgaaatttgggtatctgcagatgagaaataagctatgcattattaactttaaaagttggagattgctcttccaaaaatatgcagtatcactgtatgagaagataaggtgactgctgcctgtgtaggggtagctgaagttaccaaaagacatttttgtccctagaaacatcttattacaggggcaaagtccctgggaggagtaaagctcactaatttatcatgtctagcaaaatgtctcattcagagaaggtgctcagttattattaagtgaatgtgctagtacaggtggcaggtaagacaggttgtcatcttgggacacatgaacatggcagtggagacatcgcctgccaggcacagtgctgtgagctttatgaattctgcctgccctcacttcccaagataagaaagatgccttccactgggctgttccagcacctagggtctactcatctcatgcctgtgtctcccacaaggtcatgagttctttaggagaactgtgtttaatctcctccgctctgcccccaatccagcacctggtacatactggctattgatgaacaaattcatgaaagaatgaataaaaaagtagataaaatttggattggcttggggtggggagaggaggttgggtgtggcctcgggagctgctccagtgaggttctagagcatcttagggctgagggagacaggggagggggaaagggctcggagggcaaggagaaacttttcaaacgtcatgattttgtcttgcgtgtgagagtaagtatattgttttattaaaataaccttttcatggcacagtgttcatgtagaaagaaatgctttcttcaatagctcattgttgtccacaccgtgatgccctcattcttagtctatggtatccatcaagcatttcttcccactccctatgctgtagccaattccatctgcccctgttccactccccatcttgtacaacaagctgcagtggaacccaaagggcggggctttggggggacacagtgctgagttcagggtctgcatcaccacttatcacctctgagtcccagaacaaattagtctgcttctctgagtcttagtttcctcatctaataaaataactctttgagccttggttttctcctcttcaataaaatacacttttatgatcattatgatagatgatatagaatatatataagcccacagcactgcacccagcagtgggagacacccagtgaacgttggtgtgcatctatcccttcatccttttcttagcctagtagttcacccttctttcctgatttacctcatatttactaattctttagggcccagtttaaagatcaccttctccacaaaatctcctcccacacctcacccgcccaacttccatggaaagcaatctttcctcccctgtagcctgtcatcttctgaacacctgtggtacttaccactttcttcctggtgtctcagtgattgccgtgtgttattttttccccccagtctgtaaattccatggggtcaaactgcccaccctttactcttatttccccaaagcacccagcagaataatttgtacacaataggtgcttaaaaataataagctgaatatatgtagcacaattctctatatttagaaatcatctttcagttcttttttggatacagggtggtatatataatgcatctttccatttggtccacttagggaaaaaacaaaacaaaaccaaccaaccaaccaaccaaacaaacaaaaaaatgacccaggcttcattgcaagtcatgacctcacacaacatccagagaattccctggaaacagttataaataaggacttgtcacatggacaatcacaacaaagccctgctcaaaagctagtcacaattctaaaattgtgcaaatgcttaactggaaggggtatttctcaaaggctagctagctagtccacagttattgccccaaacatctttgtctttattatacttccttaaattgtacaacatgaaagtgacataaatcacatatattattcttattttccagtgggaggggagagacccttgagagtttgaagaggccatgcctggcttctaccagatctgaggttactgagctggctttgagccttttagatggagtaccagaattaggtttaagccagacttggcttgtcatggaggtacctgtcgaaggatgcaactttacatggctggatggacagctgctattccaaaatattcttttttctagtacttgagagggattgctatgtatttagaaaatttaaaaatctttcagaggttcctgttctaggtgaaggattaacttcaaccagcgtttccacaaaggttccatatcagaaagtctgggaaacactgtctactccatccctctttacaatttattatatgctgcagtacacagcagcataatgaaaactctgagaagtcacgtgataaagagatctattaaacttaactcagaagctctcccacttatttatggaatcagccttgcctttttgctttttctttttttccttgttgttgaaaaattcttagtgacatcctatgaaaccagcatttcacttttaaaatgctgcctttgcagttattacccatcactgtaatggggataaattttcagctaagaatgggacacaaagggatatgcgtgaggggatgggaaaatcaagagaaggataaagtatgttgagggtgacccagggagggcccccaaacacaatttgacagttttgctcagggccagccatggttctcatttcatacatgattttgactgtgttttcctgcttccaaagcccggttgttatcaagtgatagaatcagattggaagtagaatttgcatcttcgtcttatcttaaattgtctggtgtagggaggaaagaaagggaacacttggacaacatttgctcagatgaatgtgagaagaggaaggaaaggagaaggggatggcagggaaacaaaagtacgtaggaggtaggacattaatgatagaaggtaatggacaggatggaggaaagagagaaagtaaagggcttgacaggtcaggtggatgctaacaaactccccctcctaagccaagaataaaataataactgggacaggagccttccttaaatgtataaatggctccttctatccccttggtagcaggtacttattcctacatgtagggttctgtcattggacctcttgctgcccatgggtctgcatttccccaagctgttggtagggcccagtgtgagatcctagtagtggtctgctgctttagaaaatatcatggtggttaatttaaagcacagggctagcaaaagagaagggcctaggtgttgtgcaaaagccagagtggagaggggctgggaaggggcttcctcttgcccggggttgtcagatgtttcacttcttgcatgcaaagcaactaggagatctttggcaagctaaggcagcttagaatattagaagctgaaagcaagatatgcaacacatttgggagtttctctctcatgctgaagaataagatgaactgattcctctgtgagggtacctttccatttcttgtcagtatccatgtaaaagtcatgtaaaaaaccttaaatgtttttcataacttacaaatattatatatttttaaaaagtcgcagtatgtatgggatgaaataggggttaaggcaataggacagctccctttccaagaattcaaaatcttcacattgctgttccatggcaaacctacatcagaaaagagattcttcctgggacaaggctatgttctgggacagtgcctggaattcattaataaatacatcttatataaatctctactcagagaaaatggttaaaatgatatgcctatcctcatggagtgggaaccctcatgtagacaatgctactggatggaatggtggacccagcctctcagagtaatgctcctatctgaaacaatagggactgcagggagacaggccatgagcctacagtcctccacatcagaatcaggtgtctagctggttctgggtatagaagatacttcagatctttcattcctttgcataaatcagaaaaccaccagaaaatacatccccctctgaaataaaggacatattagaaaattattggatgaatgtttctatatgttttgtgagcatgtgggggaaagtactggcgcagtgggtatttgtgtttacattactgacaccatttctctgagtgtgttacataattatgatggtttgaattgtctgaatggaataacatgattacccatggtattgcacgtctccaattccaaataaacacaatggcaaaaactagacaaaaatgcagaaagaatagtaagtcacacaatgtcactgaagtcatgcagagaggaaaaaaaagaataaaaaatgggcaagcaacagacaccataaatgtaaaaaagccaatgcatacaattctaaaatcattcttaccttcttcagtcattgtgtcataatattttagttttccatatgatccaagttctacaacatcacagtaaaagacacaaagataaggaacgagctataatgcaagaactttgtttttacacatttttaattaatcagattcagagttatactgtcaaattttgcaatcgtaactatatggagatgtgcaaacatgggccatgtggcagacagctttcacggcccattttcagaaatcactttaaatatattatgctaccgggggtagagtgtgccctgcattacagaatagggcacagttatcttaacatccaatgaaacagagtatttggcaaagataacttcaccccaggtctattgtaaccctgtaatttttatagaggtgacactccgagagaaagggactgaacaaggacaacgtccaggctcatggaagcttgcagacactgtgattccttgccacagaacagcagttcaagaagtttatttcacagcttttctccaacagaaccatttcctagagaaaaaggaagcctacctaggaaaatctaacatgaaaaaccacgttctaaacttccctttctcttcttatattttagacagacaacacagagtgctctgggaggaaaaaggaggcatgttcccagggaagaccaccagctcagataagtgacagggcagccacagctccaggactaaggcattggtggctgctatgtaaacagcaggaggcagggcaaggaccatcagctccccctctgtgtacacatcatcaatggactccccctataatggaaacccctggcagaatgtgagctgttttgagtgagctggtgggagtggcagctgcagttgaggggagagaaggagtgggatacaccatttctgttttcttcagttttaaaatagcaacttttatccttgtttgtctgaaaattctagattgttttaagcaattttgtgagcaggttaaaaatatattttctggtcataacaccactctcccaataaacttcaagacattaattagactcaagagatagttctgtaggattctgcagaatgctcccatggcccattaactgggccagctgctgggaatcctcatatgaataaacttaaaattgatgggttttgtgtgcaagatgaaggatctagcttaaaatgcaataataaatattcgtgtatttcatatttgtatgatacatcatttacacattttttcatgtgcctagatttctatctaaaattgttttaatacgccagcacaaaattatatcttggggagaaaaatcacatgtttatgtttctacgaagagctgcctattctggacacattacaaaagatgcaggtgcttcaaaaagaaattgaattttgtataaatagaaagaaaatttttttcatgacttctggggattgccatcagtgaaaaaaatatatacatacgtgtatatatatgtatatatatatattctggtattttaagaacagtattatatatttgacattgcacaacttcggaattcttaaatgacctaaataccttcataaatataaaacacataaatataaaacatatgttcatagtggcttcacacataatatatgtgtttgcatgtgtgagtaatcttggagtagattaacaaatcacatcagccaactaactgttttgtgacctctcttccttccctgaggtaagcagtggaataagcagctggcattctctaccatttgctcagcaaacagaatatgagtggctctgtgtttgcaaagttggatgtaaactatattctacacagtgacaatacaccattgcatttttatggatccatttttgtagacgcaaacctctgtatgcacacacttattttcacatatcaatcccaactttcaaatatctgcttgtggcagatgatattactcctcacctcatctcttgcagaatcaggtataaataaatacattcatattgtttaattatcattttatttgtacatagttggaattggaactgttcatatcggacaaagctcacacattctcgacaacgtggcaatgtctagatcgcttcttagctgcttccttggatatgatgaatgagactgaagaacaagaactaggcagaacataacaaaaatgagtctaatgatggtggaagagaaggaagaagagtagtgaaaagctgaataacagcaggtgttgtggcaactcaaggcgcactgaggaagcagtggaagggaatggtatctgcccaaacaaagagaaccatgtttacagtttactgaagaaaagtcagaaaagaatggagatggaaaccagcctgctagaatacggtctttagcactaacagcaacaggatggtgagatggtgaactcagcagcagcatcctaaggaggattgggcagcatctccaggagccacaaggccctcctccctgaagcagggactcaggaggtgcagaaagagaaatgacatgcgactaggacaaaaagcatgcatgcataaaccagagctcatcatgcacttggctggggtcctacagcccatgatgcctcctggaacgtacccttgcccactgtctattgacagcctgtggcaagacctagtcttgctgagaggacccgggaggcgctcaccggcataggaatgtggcttgcaaccagcacactctccataatgaataactaaggcactttgaacataattggattaggattcaaactggggctaatccaaggttagtttttttggggataggaggaaagaagtaagggagttcaagagtctattagttaacattatctagcactgttcgctgtatcagtgaagcaagaggcagctaggattggaagagccatacatcacctgtgaatgtcattctgggtaccacctggtgcctcttctctataacatttctctaagaagccacacagatggagaagaaattccagaaccctgtggtcggtgtttgagatgagcctgtaatccgattgtaaatgctgcccattatgagaatcacacttgctttcatgccaccgtggtggagcccacgttactgagatgtgatgatcccatgaccaattttctcccttacgtatattactacccctctaactctgtatcacactagccaaaagagtgacttttttgttttgttttaaactttactttggggaggaatgaaagttgcccattagatgtaacaactcccaattgtctcacagggacagatctcgattatggaaaatatggtgaaagtcctgaaaggtaggttataatcacagagggagatctgaatataattatgtaggaattatcatcctcgaacagtgaacaataatgtgtggtcattactgtggatcatgcagatggttcataatgaaatgcccaagcaagtccccagattctgcaacttcttataaatttgccacttcattttcagccttgcttctctgtggtgttgcttagcaatatcagtggttactgatttctgtcttgtgaggagctgactcaggccatatttcaccttattttacatgctctggatgatcaagcaagaaaaatgggacctagatgtgcttttctgctgctgtccttttgaggtgggctggggagggggagagcgtaggattgaatatgcaggtttctgaaaaggatttttaaagaaaaacaataagcaacctagacaagagaatcaacccaaaacaatctgccttttatgagtattgttttgagaagtgaagccagctggacttcctgggtctagtggggacttggagaacttttctgtctagcaagaggattgtaaaacgcaccaatcagcactctgtagctccattgtaaaacgcaccaatcagcactctgtagctagcaaggggattgtaaaacacaccaatcagtgctctgtagccagcaacgagattgtaaaatgcaccaatcagtgctctgtaaaattgcaccaatcagtgctctgtaaaattgcaccaatcagtactctgtaaaatgcaccaattagtgctctgtaaaacacaccaatcagtagggtcctaaaagtagccaattgcagggaggattgaaaaaagagcattctgataggacagaaatcgaacatgggtggggacaaataagggaataaaagctgaccaccccagccagcagcagcaacccacttgggtccccttccttgctgtggaagctttgttcttttgcttttcacaataaatcttgctgctgctcattatttgggtccatgccatctttaagagctataacactcaccacgaaggtccacggctccattctggaagtcagagagaccacgaacccaccggaaagaaccaactctggatacatttttactgtgtaattaaaaatctcaataacaatcttaagataattttaaacactgacactgttagaatatttttttttttcctttttcacaaagtccaggagataagtgatgatatagcatgagggttgcatatatagtttggagccttacagaccttgacttgacaactgggtctgccacttgctagccatgagaccttgggcaagttacctaatgtatttgagacttagttctcacacttatgcaaatgagaaaaatactagttgtattctagaattgtggtgagaattacaggtgcttaacctgtaactgacagataatattcactaaatatatggtaggtattattatgactttagtgcatcagttggttttccttcaaattaggaagctcccatacatagtactcttctgatcttcaaaaatcagagtgaactttggtatcaagagaccttatcattataatgcagaacaaggagatcttgtagcacagtggaaattttggagtcaatagatatgggttctaatccagactttgctttttattaccagtgtgactttgtagtaagatagcctttcacaaccttagtttcctcatctgtaaaatggggctcattctagtacgtccctcaatatgttgttgtaaggagctttgtgctatgcctggaacattggaagtgctcaagctcatacatatagaacccatcattctatgattgggccaaaatctagtaagtgatgagttgtccagactaagataatatgtcacaagtgaccacccaggatttgaaccttgttctaacatccttttcacaagtttatattggagaagaagcaggtaaaatgagaatgacaaaaataatgaccaatgatgtcatgccaaaggaagtctatgaatgtcatttatattcttttgtataatctaacatcaggtacattgagacctgatgtcagttacattggtattatttaaagaatgtacaactcagagaaagaaatgacataaagatattaggttttggtttttgaaagggaagctcaaaagggacttcagctgttcaggaaagtggtattgtccagtggttaaaagagtgtgttctggggtccaacaatcctgggtttgaacccagctccatcagtttctacctgtgtggtcttgggtaaatcatttagctactctgaacttcaatgtccttatctgtaatatggttataataaaagttcttatcttataggattgatgtggaaaataaataagttaatctgtataaaatgcttagcccagtgtctggcaggcacatggtaaatattcaataaatattagttattcctgttgtcactattattgcctccccatgcatcaattcagagttcgagctgaatattcaacattttctctggtccctttttcagctctagtttgaagggaaaaaataatattaaagatagtgaaaaaatatgatttgaatagcaaagaacatagaatatctgaaaccatccatgcaacagttggaattcatttctaatttcagaaaatctgtttgagctcttctaatagagtatttctaaaatgtgttcttaattttttgtgggggtaggtggatggggggttaggaaactaacattttcattaatgacatctatcatcttgggtacatttttgcttgtctataaattgaaagattacatttacaaaatcaagcaaaaggtactttctcattaaatcctatcaattctgggctgggggttacaaacacatttattacccactcttagaagtggcaaaatattccattatcttcctctgctttttttaaaaaggatttatgaagtgctgtgtacagataggcctgttggtttctttcatagaaacaggagcttggttatattacatgtgactaagatccacagggtgaggggagggaggggggcactaaggtgatgctgatgcttctgtaagccacactcacaatccaaccagtcacaaagtctaattccacccctaaatatcttcaattctgtcttttctgctccatttccactgccctggccttattctgaggctttgcctagactactgcaatggtcttatttgcactcttcttcccttatctttcttaccacctgtctacccccagcacctttcacctatctttctcatcattatcaaggtaatcatttctaaacacaaagtgaaactataacacctctcaatcctgcacatactgtgattttgcgttggaattttactacgtctcctaatttactgaatctttcagaaccccgttgaggttccctcctccatgcagcattcctgaatgcccccatccctaacgttaagtcactttcctcctgtgtgtctgttccaactatacacttttgttgttgtgctcatcttatcaaatgtaccttaacctacttgttttctgccctttaaggcaaagagtcattgtacgcattttgttaatttcagcacccagcagagtaaaggggcactctgtatgcgttcaacaaatgctgctaagttgaattaaatatctatttaaagtgctctgttaatcttcctcacctttattacctttggtactgacacctatgattcttcccattttagtgttctaattccacagcttcaactattctggcttatagtgtctctatggggaggaagccccatggggtggtcttgactcttggaatccccttcattgcttcagtgaagtaggaggacttacatcatgcagaagagccatcaggagagtcctcagcacacaaaagacaaaacagcagcactgtctttaaaaaatggcaatggaaactaccagtgcacagaatagatgctgcatgctggctagagaacaacttggatatactcctggatcccatcttgtggcctggctggattcagtggtttttgctaggcaaagagaatcagtgctaatttatatccagctattgggtcagcaaagccgagtttctaccctctggtgcatgaaagcatccaataatattagaaaaatatccaagggaggagaggaaaaccagtaaaatgaaaaacaaacaaacaaaaaaactccagccatccaagaagggaaaaaggcaagagataagagaaatatgagagggcaagggaatttgagaacacaatgaaattaagggaaaaaggactggaagacataaaattaatgccactgatgtgacagtaattcaaggtaaaaatcctccttacaatgatatattctacactacagtattgtctggcatgttattttcctgaatacttggttctttaccacaatagaaacaatcactccaaattatgaataatttacaggaataaatttaaagtagaatgttcatacaatcctttaaattccatctgttgtaagtataaatccatgtaccattactcctattaaatactagactgtataagtgggattacataagtcagtttaaaatccaggatgcaaagaaagggtggaagattaagatatctttcccaaatagttatgcatcttagattaaatagcaaatgcctgccagtaaaccagagatctggttacgcaggaggagctagggcatgccattatcttttgacccccaagtgacacccaaagggtggcctaagaatgtttcaccagaattaaaaaattaatagagagaataaatgcttctgtagattttttatcaatatattggaaagatacattttttagtctgctgaacacctatggaccccaggtagaatttttttcaagtctgctcaatagctatgaacccaaatgaaatctggccttttggaaggaaatgagttaagtatcatgtgacatgatttccttctcattgtacaaaggacaggagaactctgtaaatacagagattaaaattatacagctttgggataacttttgctcaatgagaagctgatgaatagaaaatcggttcccatgttatcttatagataggtataccaggacctgaagatatggcacatggtaaataggcttctttttcaggaaagaaaatatagaaaagataattcaaggtcttatgattgaaccactgaaagctgtctaaaattttgatggctgcaagaaaaaacgaacaactgacagcaacttattgggcaaatgcctacagagaactaatgatgtggcaagcactgttctatgtgccctacaaatagcattccattgaatacacttaacagcccacgacagataccattatctttcctattttacaaaggaggaagctgagttacagagaagttaagtaacttgcccaggggcacacagctagtaagaggcagaactggggttcaaaccaaggtggctggctcctcattgtgtctgctcagtaactaactctgctacttctcccaagaatctgatgggaagaggtcaccatgcacaccccaagcagggtagagagggtttttctaaatgggcacattgtgtgatgtcacctttgaactcctagaatcaggtcttcatggtgtaatcctcactagcattgacaagatggggtttagctctcaggtcaagaaaatagttgtaacctattccagataggaaaccttgcatgacctgctgcatcacctatggaaatgtgttgcatgaaaaaaaaatccataactggataaaaggttttttctcagaaatggcagaggagaattttcatcataaataattttctaaaatgagattgatttactatggaatttaactcctgccaatactggttgttatggtctcagggccttagagtagaaagcaaagctacattcactattggtgttttgggcttaagtgctgccatctgggaggtcaaagagaagtagccacataggttactgcaactgcatatctaaaggcaggttcaacaacagcacttaaactggcattcagggagttaactagtctggggcaagcactggctaaagttcccccagagtcttgtctacagtgggggcctgtaaaggagaacattcccaatggggttaccactcatatgtcagcttgcaatggaaatatgtttcgtaaatgaatatatgagaacacacacacacacgcacacacacacactaaacaagtctgatatagacctgtaaactatataagcaacaatgctgattgactctttacaaatgtgtatgtgcacgtgtgtataacatagcctcctttgagcccggggacaacctgtgaaggaccgtttgttgtgggtgggagaattcttttcaatggctgaagtaaagaggcaagatttggtggatctgataatgtgaggtcaggagagaaatggatcctgacagccagttgaggattgagtttacaatatgatcagcatgtacacatgagtgttgtggccagtgcaaatcccagatggaagagtcaactagaaaatgtgttccctagtgtcagagaaagtcatctcatcacagaatgcaagtcattcaacctcatgaagtgaggccctgctacttattaaacactcagaggtgtctttagtgtaaatgcctttcatttgggagaaaacacctctggatgctctcatatcacagatgatgtttatataacaatacacatttcgaataggaagtctttggtaaatgaaagtgcttcttcaccttcagtgactgcccccatcctttggtcccccaagtaattgcatctgtgacagctgctttttatctctgggaactctgagtcctcccttctgaaggagttcccttttgagcataagttccagaggagaaagatgaagctctaattttatggatacttcattgtccttttccttcttcatgatatctttgagctcaaatgccatcaaaatcatttttttttgggcagggtgcagtggctcacagctgtaatcccagcacattgggaggaggccaaggcaggtggataacctgaggtcaggagttcgagaccagcctggccaacatggcgaaacccgtctctactaaaaatacaaaaattagccagacatagtggtgcatgcctgtaatcatagctacttgagaggctgaggcaggagactcgcttgaacccgggaggtggaggtggcagtgagccaagatcgtgccactgcattccagcctaggtgatagagtgagactctgtctcaaaaaaaaaaaaaaaaaaaaaaatcaactttttggccacataccttgtggcctttgcttcaaagccaaccttttcattggagaaagaaagagagagggaacttttctcatactcaaaagcagtttatttcagtaagacaattcacattcccttatggctcaaataacattaatttataatgtgtacaacacaaagagagattcagtttcaaccatgtttcaaattcaaatatgagaataatgctttactattccctaaagagaggagctatttaacttgtcctgtgtttgctctatgagaggcattaatggcctgtcctcctctatccagggattgatactactgtcatattagtagaccacggccagtagattggattttatttttctccagtgaagattttcactcatttgcctattcatttaccaggcggaggctgcacgcaaacatcttggtagtataagctgatctaaaatttaagatagaaagattacaaaactgcttttgagagacaccttctccactttttggataaaagggggcatgaaatgactttctcttgggaccaaacaaaaatttatgaaagctcattttgaagctttttttttttttaaatagaagctaagagaaataagctctggtatttggtgagacaaaaagcaaacccagcaagcaagtgacagtttaatcttagtgtcagcttcaagttaacattaagtgtctgtgttaaagacttggaaagcctttacagaacagacagatgtgtgaacatgtgtggccacagatagagtcctgtgtgagtgaagtctccaggctcagaagtcagacttgggagctgggtgactatgaacaagtcatgccaccccttggaaccgcagttttctcagaggtaaaacatgcatatgacttcccatagccactgctgagagaattacatgagatgactttcgggtgtgtggcacagagtgggtactacaaaagttccactttcttgttttccttctctaccatctctgaggcccttagtttcctgcactgaaatctctctctctctctctctcacacacacacacatacacacacacacacacacacgcatagacactcgcacatacctagcacccctcgacaggagagactgctagagcgttagttcagtgggcaaggagctacatgcctgctcatctcaaaggaaccacgttttggttgggacaatacatagtttggggtttccctgagccagctggttcctctgctcatccaggctccttacctccttcaagaacctgctttcaaaactcactttctccaggaacacttccctgaaggcccttcctcagggttcacacaatgatctggatttcctgagggtctggcaagccttgcttgcctgcagccagtgctcactgtgtccagtgccgtgcctgctgtacatccaccagggcgcttgccatgccagaaggccacttacatgaatgtgcgctctcactgcttcaggaatgagggccatgtcccttcagttggggattcaaatgctccaggaagcccctctcctgccccgcttggtgcctcaccaagagcagttagtgaatctggccagggcagtggtgcttataccctatggcagtgtgcccctccagggccacctcagaggagaccccggtggcctctgatccagcctcttcaccagcctcctgaatacttcagccagaacatctaaaagctgctcttgatgatgcttttttgtacttctttgttgaaagtgttggacactaggactgggattgagttgcatttagagtttaatttggagagaactgacatctttataatagcatttatttagatcttttatgttcttcagaaatgatgattgtgatgatttttgccataaagttcttaaatatttcttttgggttaatctttggtattttatggttttgttgcatttgtgagtggggtcttcattgctttcatgtttaaataatcctttagttcaccagtccccagcgtttttgacaccagggattggcttttgtggaagacaatttttccatgggtgggtgtggggtgagtggtggggatggtttcaggatgaaactgttccacttcagatcatcaggcattagattctcataaggagccgcaacctagatcctcacatgcacagttcaccatagagttcacgctcctttgagaactgaatgcctcctctgatctgacaggaggtggagctcaggcggtcatgctcacccactggctgctcacctcctgctgtgtggcccagttcctaatggaccatgaactggtaccagtccatggcctgggggttggggacccctgctttagttcgattacaggtgcattaggtgagaattattcctactcctatgtttcttaaggtgtctagtgcatgaatttattaaatattggtattagtaatacaactgttgttacaatgaaaaaatgtaaatgaaaatttgaatctacacaaggaaggagaaattactataattgtaggagagtgtacaagagcccacagaaaataagtaagaaccttcattttttttgcaatttccttctcaaactcaacaccaaattgaggtggatgttattttacaggtgtttgattttgtaaaaggaatgaatggttaaaacaataaacatcttagcttcttgttgcgatgataattctctgaacatataaaattaggcctggggaatgtaataaaggaaagaacagtgtattaaagagaagaaaatgaaaggaaacgagagaagaacaaagcatttggatggaagagaggaacaaggagatggaagaactcatcaggaaggtgtgaggcagacagcaaacatttcccattgcagcagtgactccaggactagagagagatatattccattatgcagcaaatactgaccaagcacctacataataacatcattgctgtgctggtactatacaatggtggccaaaccagatctgatcactcttcatagctgcaagagaaccatcaagtaaatagaactttgttggtcactacaacagagccctttgacagggcatggattaagaaaatctacatggctagagacatatagttccctagcagaaaaattataaaggcaagtactcattcaattcatttagcaaatatgtactggggcccacttgtgccagacactagggatagagccaagcctgccctgagtcctgctctgttggaggaataagggtagagacaggcagcatacaacaaatacatacgttcacggggacaagtgttaaggagaatgcagagcagggagagggagagtgagaactcggattcactttcattgttttgcttctgatattttcaaaaggttgactgagtaaggcctctgatcaggtgacatgtgaaggctgacttgaaggaggggagaccaggagccaactggatatctagaaaaagggggaacatgtgtaagggccctgaggcaggagtgtgcttgggatttggaaggagctgctaggcagtcagagaagcagaacaagggaaatgacatgtgagagaaaagagagaagggtagagaaatgaggagacaggaaggaggggagacgagggggcaaagcaggggaggaagggaggaaggtgagagacgggcagagagagatgagggagaggaaggaggggaaggaggggaaacgagggcagagaagagggaaggaggggtgagagaagagaagagaggataggaggaagagaggaggcgggaggggaaaggcggaaggaggtagagtgggaagttgcaggggttctggggccgctgtacgctctagggcttttgctcttggtgagatggttttgagcagaggtggggtgtgatctgacttacattttaggggatccaggattcttctatggacaagtttggggcatgccttttctggggaaagattcagggccactgtgaaataaattggactcatgggtcagcagacagcccttcagaaagagggaaaaggggaacttccatctcttccctataaattgagaactcaagaagactggacaaagttactagggatgggaagaagaaggtgaacacatttgactctaactgggctctactatggagttacataatgtggtcctgggaaaatagatttccccaaatcgatctcatctgagaagcatgacacttgtgaggaactgctgatgagaggtggggggaacagagagtattaagcagcagggctggctctgacaacctgcattaaaaagctgactctactatcctaggactgtggcttcaggcaggtaagaaaaccacttggggtctcagtttcttcatctataaaatgaggataacagattctctctcatgggcttgctgagagaattgagtgagataatgtttgcaaagcacagtacctggtacctagtaagtgctcaaatgtgaaaaccaaacactattattatcactattactctctggagcaagcaagattctatactgaggtccttttctgtccatttcttaataacatttagcatttaactggcacttattctctgccaggccttgttgtaagtgcttttcatatactagctcacatactcttcatttgttttagtttcctttttttctaatttagagacagaggtcttgctatgttgcccaggctgctcttgtactcctaagctcaagtaatcgttctgccttagcctccagagtagctgggattacaggtgtgtgccaacatgcccagtgtatattagctcgcatactattaaaacaaccctatgaggtaggtattattactctctttctacaaatgaggaggttgaggcacagagaggataaacaaatcatccaaggtcacacacctagtgaaggacagagctgggactagaacccatgggggtctagtttcagtcaatcctcactcttattaaatgctgtactagactacctctctgctcattcactgctcatagttctttatcaaagacaggaaacaagctgggtatggtgtcttgtacctgtagtcccacctactcaggaggctgaggtgggaggatcacttgagcccaggatttcaagtctagcctgggcaacataccaagaccctgtttctaaaaacaaacaaaaacaactgataaaaaacaattttcatcttgaatcatgtatgggatcttctgtgtttggtttcctactactcagcagatggagagaatggctttggaaccagatcaatgtcggtagagatataacatccatctgggcaggtcaccaagctgctctgggccttggtatttatccatgaagtggggatgatgagatatataagagacaagtgttcaataagtggaagctactattgccaatagtgataatgctacactttgttcagtaaaaatactaccatatagtagaccctcactttttaacaactttgttatctctttgttcaaggtggtaattttcacccctgaatttctactagtcatttgccttgtggtgactgtgattgatcaccagaaaagactgtggtattcctttctctgaagtctttgggagaacatatatgcctatatgcctgccaaacacaacctgccagttcctgtctagagatggcagcctgggctgcagaagctttagaagcagttcaagaccacgcattttacaattttcacttctttgaactgaaaccatcaaggcacaggatgaggaggacatgaaggtggagagaggaagatatcaccattttttctctacgctcctctttccccaaaaaggtcaatcctaaacatctttattcccagcattctattttcttctccttgtcccaaaccagaggaagagagagcttttaaaaaaccctctctggcaaaagaggttctttaagtcttcctaagtagaagtggtagcagtagtagtagtaataataatatcaataacaataataataaaatccatccctggtccagggataggtcagagctcttgtgatttaagctggtgtctacaccaggagaacaaggaatgctgggttggacatggggttacacaaggaggcagagtagcagaaaagaactacaaacacagactgtgagtcaggcagatacaggttcaaattctggctctgccatttacttcttgtgtcaccttgccttagtggggcatagagccatagcctctttacatgtcagtgtcctctgaatgatggagtagggctcatggaaggattaatgagatggtttatataaagcactcagcatagtgcctggcctacagaaagtactctgcaaatgttggttggtgctatcattttgagacaaatggtaggagaagatacttctcactgcaaaactgcaacatccagcatccttgtttttaggttcatgaagatgtacccctgagcaaatataaaggcttgtttagagaaaatgttaaaatcaatataggacactgaatttattagaaagatcaattcagatagccatcctgtgatctcaaagaccaataattctagttccccaaggttttcttataaaagaaagaaaatatttattccaaccattcatctgccttaagcagattccatcttttcatgaacaatgtcctgttcagagttttgtgtccctgaaaaggcactgttcagctatgtttgaactaaaccttcacctagtcaggccaactttgtcccccctacataatgtggtccatccagagcacaccaaggaacaatgaacagtggaaccaataaacaatgtatgtcactgaaacagactggatcacatccaaggtggtttcaccatgttctttggtattcctccctttgagaagtgaagtctaattttgtccccatgagtctgggctggacttagtgactgcctgactgattgaatgcagtacaactgacatcctgggatttcccaggctaggtcatataaagccttgcagcttctgcttggtcttcctggaaggtttgctcttggaacccttaactaccatataaaacatgttagtctatccacatggaaaggtcctgagaccacagggggaatcaggggacccagttgagcccagctttccactgtgccttcctttgtaggtgttaagcttgagtgaggtcctttcagaccttctaacctacccatctaccagctaaataccatcaaatgacctccaatgatgccacatggaacagaaaactcacccaggtaatccctgctcaaatttcgaatccacaaaattatgagtaataagatggtggcagttataagccactaagtcttggggtgctttgttacacatcaacagataataaaacgcaaacactgctggactcttgtgactcaggctcagaggcggaaccaaccactaatgaaggcttttggcaagggctcattcactggattttggaagacaacaacacctgagtggcacagatgagacaaaggggaatgtgtttctgtaggccatctgtcctagatgctgctttcaaatgaatttgaatagttcccttttgaacatacaccaaatgccagtagtgccaatgcactacccagccaggtgaacaccagtgacatgaacgaactgttctttagtgctacaaggaagctactgactgcagcgttcatgccatcaacttggtgatgtaactagcatgctctttgttgttagaaggtgacagtttggcacaaggacatgtgaattcaagtgattagatgcaaactaagagagatgactatttctgagagctgtgggttaattttttggctgttctcggaatggaaaatgattgtgaattttgggggaaaaataccagagcaatctgttttcttggccgcctgctatggagcaattttaaagcattgaagtgctttccatattttctaatcactcaagtccagagctgattatggctctcagcatctctcagattcacaccactgtagcctcccacatctttcagggagaggtttcaccttgaaagcaggtgcctggattcaggaggcacatcttgctacagcaggaatacagtttaattgtagcacagctccacaagggccaggcgttttggaaaatcactgatggcccaactctgagacaacctagattcactttcccttatctcacaaaaacaaaacataacctcttctccaaacagaaaaaacaaaaacaagccctaccagaaactgaattcttccaaacaaaaaccaggaacatttagattattgagacctgtgggcaaggacatgaccacattcacaggcgtgcacacacacacacacacacacacacacacacacacacacacacagttgcatatgattaaacatctctagaaggagcttcatgaaactggaaactgtggtttcctctgtggagaattggggaactggagaaaattagagggttgatgaaggaagaagacattttttttcaccttaatctttggaatattttgaatttttaaaaatcatatattgtgttacttttcaaaataatgaagtagaataattccaaacctgcatatggcaattaagatgtgctaggctgtgtatttaacgctttgtgtatattcacattttaatccttacaataacactatgatgcagacatcattatgtattttcctgattttacagatgaggaaactgagatacggaaagattaggtgacttgtccgaggtcacacagctagtaaatgcagaactgggatctggacccagagtctggttcgggagtctgtcgttttaattgctacataatactgccttgcccaaaataaacatactcaggccctttatcatacttgagttggagtagataaaattgttcctttcttctctcgcatggtcaatatcaggtcaatatcatgactttgaacaagttgcctaatcttcctgagccttcatcgctagtatgtaccaggtattcttctaggctttgtgggtaactagtgaataaaatagagtccctggtctcaagaaacttcctgtatcctggcagaaacaggcaataaataaacaatcacagaaaccatgatataagcagtaaagaaaaattaaaggttcattggcagatgaggattgggaaccctgatttatgctgaatggtcaggaagtatttacacagagtgctgaaaaatgggcaggagtaacgcagggaaaaatggaagggggtgggggaaaggaaaatattatagtggagagaacagcctatggaaaaacctggggcagggaaggggtgtttgtctgaagacagaaaggtctgtgtgactaaaacagagtgaaattgagtttggagcaagaggcagatcatgtagaccagcggtccccaagcttttctacaccagacactgggtcttggggaagacaatttttccatggccaggtcaaggaggatgatttggggatgaaactgttccacctcggatcatcaggcattaaattcgaataaggagcacacaacctagatctctcatgcacagttcgcaatagggttcggccccctgtgagaatctaatgcaaatgctgatttgagaggagggggagctcaggcggtaatgcctgctgtcctcctgctggtaccagtccgtggtctgggggttggggacccctgtcatagaccatgatttggctcacgtcccaccctccaactgccatctaacatgtttgaattgtgcatcctatcagcaaaatttttaaatgtatataaataggtatctatattcatatctatatctatattcctattatatatagatacaagtactaaaacatgaacagaaacattttcaaaaatagaagctaagaagaatgacaacgtaaatgatgaaggtgctgatattttctccttgcttcccaaaggatcgtcttgcatatctcctgatctacctcatcttcaccccgggactacagctctaatccagaaagcagtatggcctgttttaagtgagattcaaagaaacagaaccatgagaactctcctgactttgaggggggctccttttgcacaaactactagttgtgcaaggatttcacaattttcctaagagccctgggaagccactgaatgttataagtagaaatgacataacctgatttactttttaagaagattacttgggctgctgcatggaacatatgtctaggcagtggcaatggaagaactgaaagaccagctaggaagctactgcaggaatgcaggaatgcaggcaagcgatggagatggtttggaataaagtgctgcaggagggagagcagtagatacatttgagatccatgttggtggtgctatattttgtgaaagtagaataataatgttagctatgaagcattattgtgaagcataagtttacagaggtgaaaatgctttgtcaactgtaaggtgccaaagataactattaatattactatagatgatgaaaccaaatactagagagaccctaacttgcccaaagtcacacaactgcttagtagttgggaggaaggagttaaagcagtcggcctgcaatctctttactcccttctctgggggtatatcccaggggaaagaaaagaaggctcatgaccaggtctaacatccttgtcaaatggacctccgtgtagatagagtaatgatatttaggatgtccctggctaagaattacctctagtaaacagatcccaggacctgtggaggaaggcttcttggagaatatcacatcagctatacaactctctgtggtataacaggaagatgatttgtgattgaaacgccccatgctctgcaaggagaggcgaccctgtgttccttacctattattctgagtgaggtgcatgtccaatgaaggaagataggtccttgggagccactcttgggtcacagatttttctttacctcatatgaacttcttgattgcttatattcttgaaattatttagcaaagccttatattgggtaagatctctgattcatacaacatgattcgacaatcagatcccctggcttcattcagtggcacgtatctatttcctaggctgtattagctcctgtgtaacattgagcccaattataaagtccaaggatgaagggagaacatacttggttatatttgaaccccttactagtgacaaaactaatatttatttgacacatccgatatctatcaacttgaaaataattttggggaatatttatgcagctgaagaaacacaatgtatttggcctcattgtgactgagtaacactggaagtacacaataatgggttgtttgtgatggttcatgtgattacactgggaagtgagccaggctttttgggtctccaatgacagctcctaagcagttctcaaagacagggctttttagatgcatagatgctcacctcccaccctccaattgccaaaggatcagtacactctcaacgttctgccatgaacatcactccccaaaccactcatggacctcctaaatcatagagttctttttctctcttttttaaggtgcacaatttatcttcacacacaattttgttttgaaacttagaaatgatgacaaaagagaactgttacttcagctggaagggagggaaacctttttgtcctctctgcttcataacaaactatatttatgctggaggcatcaaaagatagaatcagcacacggacctcacatcctactcctggtacaaaaaacactgatggtgaactgagctgttgcagataaagcacgtcaaagggccagggctgcttctggcagaagctaaacaagaggaggctggcaggcgtgcatgacgacagcacaaacacgttttatgcagagaagccttttggcatccttttccccccaaacaagttcccaaaccaaagcttgatgtttaccttcggcgagtgggtcaagggtgtgtatcatgagttggaagatgctattcctcatgagactgttgtggagggaggcagagcttccacctcgctggagacgcggcttagcctgagcagagaaaccaaagagatggttagtctcaggaatgaaagacaagtgcattatagacaagatcctcacctagtctggtggccactcatttctgtcgcatgatcacacagtattgagccaaagattttcaaagcacatttcaaagcccctgagggaatggctctctcacattctttcctactaaatgaatgcattgcttccctttttaaaaagagctttgtaaatgccagacaatgtgttatatgcttcacatcccttcatttatcttatttgcaaaatgaaccctatgaactagatgctattatttattcttgttagatagatgaggacatttcatctcagacaagtgaaatgaggtgcccaagtcacactgacaagaagtggaggatggaggaatggatcccaggtctgcttttctcaatgactattctctaaaccagtgggtggtctctaacatttttgaagtatgcatcctatcagtaaaatgtttaaatgtatataaataggcatctatgcccatatctgcatagatacacatactaaaatatgaacatataaaaacactttcaaaaatacaagttaagaagaataacacagtaaatgacgaagtgctaatattttctccttgcttcccagagtcttgcacatctcctgggctacctcatctctaccctgggactacagctctaatccagaaagcagcatagcttgtgttaagtgagattcaaggagcagaagctcttatcatgaaaccatgagaactctcccgactttgaggggggctccttttgcacaaactactagttgtgatccgttggccaaataaaaggaactggtacgtgacaaggaagaatgagtatctagagataaggttactgacaaactctttttcttctatcttcaaaagcaaacaacctaaaaactcccaaaccctctgtattttgatgggtttttatcctgaataggaactgctgtctccccgtggttgattttgtgttgatcatcacaagagaagactctctgaggcagccaagctttatagacagacagatttaaggagttgaaaggtatcgtaatgtaagggaattaatttcttattgaactttcagcgtaaaagtttgacaggtaaattttctggggcaggtaaaaataaaatactattctccactatgtctttcaaacttctgcataacagggttttccaaaatattccatcatactccagacccacaagggggcttccccaaaaatgtcccataagagaccccatgatcaaatacatattggatatatattggaaagtgctatatcctagaccaactcacctcagggtttcaaactacatcattagaccactaagtctaacactaaagaaatctgtttaacttgattaacttgggcagtgtttccaaactattatccataggatcttattttgtaaaacacttgttaacaatcatggtccacacatttggagacaaacatgaaacccgtagaaagtatgagtaaaatatcactatgagataccagaagaaatcacattgccaattcaatagggatggaaaagaatcagtggggattactggtgcctcaatggtgaaccagattatggctccttaatagaagagattgagtctgtatccgtgttctggtactggatcaggtgtattctatgggctctcaatgaatgttatgtctttgccctgagcattacaggaggaaggacagggtcatatgtatctttattactaactcttttggccttgaaagtcttaaacattttttaatgcattgtattattagttatagaggattcagatgattacggttcaaaacattttaggagcaaacttaggagacctgaataaaatggaaatgtaatcactgtttgatggctgaacacaataattctgaaggttgtttctttacgatggtgcaaaatctgaaatgtgatgtgttaattaaataggaactcgaaaatgtgtttatcaataataactcgtcataactattatggtccttattctgcgaaactggaagaactctggtgtggagatcttcatttgaaaaagattacatctagagaagtactgaaagcattcttttgtgtattatatatacattaagtatataggtctcatgcagcatttctttcttttgatgagaccaaaagaaatttccaatcaaagtatgtgcatgcagatacacaaagaaaacaaatattgagcattagatcccacactacccccaaatattagttcaacatcccttggaatgcaatttggaaatatctcactcttccaacttctacaaaagttcataccaaatggaagagaaaattcaaacttttgaaacctagtcccagaaggcatgtgtccatgaatgccagaattcagtcatcactaattgtagcacggagtagaagtacacatcaggggttagattatttaagtattccaagggagagagtaatgtgttgagcacacaaacccgtctcactcccacccctgccccacgctctccacaggcacacaaacaggtacagacaaagccactgcttcctaccggtagagttggttcatccttgtccctggctgcagatggctgcataagagaaaaaggcaaagacaaaagacaaagaaataaataaatgaagaatcacatatggcatttacatttaataacaagcatcagtataggggaagatttcattctttctgctcctgggatgagttaagccaaaacaggggactaaggatgtatatttttagccaaaatataatggtttatttaggtacatggttcattctcctgaaaggtcaaagttgaatggccaacccgaatgtccagcaatacagagcagttaagtcaactgtggcccagccatgcagtggaatactatgtgatcattaaaatgaatgaggtaattcacatgttctgacatggaaaatatctattgataactgaaaaaattaaacatttataaatatttattgtttcatttcataaaggaaaataattaatattttagtgcatataaagaaaaaaattctgaaagaatgataccaaactgttattagtggttgttactgggggatgggattgcaaagaaatgtcattttctatatgttttggggggagtcagcattcattgctccatgtattatgaataaaataaagctcacagaagttaggccactgcattaaagactaggatcatcccatatggaaatcagataacccatctttccttctgttcccatcacctcaagttttctattctaaaaagagaagtctctgtccagttgagaaatgtggattagaacacaagggcacataaaggcctggtaatctgctggaagcgaacgcaactcagacaagggggcagtggaattctaccgacatgacccacctggacagcttttacttccttaactcaatggcaactctccttcttcgccagaaccggggaccaccctgggatctttccaacgagatacaggtgcctggtgaatagttcctcatacttagacagcaccttcgtcacttcacctcaactacaggtgcagacagcaagaacaaactggaacccttcccctgtctggccttctggtcctccccattagggtctaaacagacgtctgtcttcaggaataatcacatacttggaggagagtagccagatgcagaacagttttaaaaccttcatgtgctctaggctttctgttttagggtctaccacacctaccatgtaaagatattaagatgtccccacatctcatctaaaatattcaattacctaaaatatacacttttgtgtaaaaaaaatagaagggattcttataattttgaatttcaaattatttgctatgtgccaatcatttaagttaggattagcatgctcaaaatcttgcaaagtgaaaaaatcaaatctacaatttgttttcacatgtaatggatttttaagaaggtgaaattcaacacttaatgaggttgatgttaaatattttgtggacattcaattagacatttaataattttgatttttgtagacacctttttggattctggagtcaataccaatgtgtttttttcccccttctggttccaagcatttttataggctcttgaagaacttgcaagtctcagacatagacagaagggttctgcgttggtggtaatttctgagcacagcctgtgggcatcactaaattcgccttaacccttgggttgggggctctctctcaatgacttctctaaaaacgctaatagggaaatatcctgatgccctagttcccaagagcctgcttgcagaactggagtggacaggaaactgtcctttgatttcccactttcctctgaacggcactgtatgatcctgcttctctctggcaggtcctctccttttctttccttccacatcagacagctcaacaaatggcctcacagtctacagggcaatcccctagggaaattttccagggcagcaagctcagcctttagacatacattgagattaaccgtcagagcacgcctggtcagttaacaaatttacaccttgtggctaaatgggagaccaataattatgagctggaattgataccacagtgttgacacagaacatgaaggaacaggatgaaagcagggagagaaaaaggtgggctttataagggcagaaacgtcaccagctgagagtttgaattttaaaaaatatatctaaatacatgattaaggaaggaaaaaaaaatccaaacctgtcttttggtctgaaaagaagaaaaaaatatctactctatcgacttcctttttctctcacagcaaggaggatcataaaacataaaaagtggaaggaaaatgcctgtacatagattcttcagagaaaaaactgagtgcagagacaggcctgaaattctctataaaatatcccactgtttaatgtctgcagttgacatcattcgttttctttcaagtgtaatctgcagacatgaatatacatcagggtataatatgtaaatttaggtatacacacaaatggcagcggaggccattaaaacacccctctactttccttttatgtagccctgttgcaaaagagataagaagtgtgacatatgatggtaattgcccatttccaggggctcacccacatctactgataattcgaagttcacctgacttagccttgctctaattgcatcctgaagcagcctcacagtcctgacaatatacagctgattacgttacaaattcaattttaaaggggtttaattacacgggaagtaactagtgaaggtgacaaagaaatgattttaatgtgtatagccagtgggttttgggttggcctagtgttgtgaatttattttcaaggccattaaatacatggcaagtttattctaacccatgggatattacagaagacaacttcttcaaaagaagactaacatgactctaaggattaatcttggcattcttatgatgcattttgctttttaacccccttaattttaaacacacaaaaataccactcatttgggctgtattaatatgaaagcccaattcctggtagtcagcatgctatggattggcttaacaaattcctataaataaataaataaataaatttaatgaatacatttataaataaatttcctatagctgtagaaaaagtctgttaagccaatctatagtacacacacaactattctttgaggattgtttaaaagaattcataaactacatcctgaaggtctcagatcagggctttggtgtgccaacgcagactcccctcaccatttataacagcaagactttggcaggccatcatctacttatgagaaaatattctgtaattcaaacctttattcaattaaactggcccccttctcaatgactcaaattagtcatatggtgactgcacttaaattgagcaactggaagatgactttaatctctattgtccttcctggtggaaatcccatttccttttttttcttttcttttttttttttgagatggggtttcactcttgtcacccaggttggagtgcaatggcatgatctcagctcactgcaacctctgcctctcaggttcaagcaattctcctgcctcagcctcctgagtagctgggattacaggtgcccgccaccacgcccagctaatttttgtattcttagtagagacagggttttgctatgttggccaggctggtctcagactcctgacctcaggttatccacccacctcagcctcccaaagtgctgggattacaagtgtgagccaccgcgccctgctggaaatcccatttctttataggaattttgctacttatttgataggtgttttgaaattgtccatttatgcttgcatcccagataataaaatgcatagcccatttggatagcattttgatgctataaatcagtcccaagtccttaaatcttctttcttcctttgatccttgaaagcgagaaatgattttgctgactataaagtgtagttttgatggatctttgtacatagcctttcaccacatacaggcccctagtcccacctcacacacataaaaattaggccaatactgcagtccagctgcctcagggccactcagtaagaggatactaacatgtccatggttcactctggtaattatctacttacaaatcacatatcaaatgggtcaccatgaagacttcataggacaaaagacaagtgtgtaactaagggatttttttttggtcaatgacgtggcatcagatatagaagaacaataaacagttcgttgctaaagctaagtaacagctataaacttccaccactttaacattccaccaagtcctgcaaaatgggcctaaaatgcattatgccaaggacctggaagcattataaagtctatagaaataaacttaaacatattattttgtgaaaaatataatctgaaacaaatatgcccatgattagaatattaatccaatattccaatggacatgaattttaatgtcttagaattcaggaagatctggtgaggaatgatttgaatgactgattttcatttaaaaaattaacatgaaagtgtaaaatgatgtttcctttttctttcaatacactactgtaataaataaaaacattcaaaatgtctctccttgttaaagatgaataaacctcaaagcctattgggaagactagatacaaggtgcaaagtcctcaaatctgaaatataaaaggaaaaacaccctactacctcttagtcagatggaaactcatctctttctccctccttttactttgtcttaacatagtccctaaaacattaagggaggggagattaaataaattcctagacaaagaaagaaaaatttaaattcaaattactttgactggttgctggtaattatctgacaatcatggcccttctgcaaagaaggaatctcagagaacaatgaagtgctgaagatgacagcccagggtgcaggagtacccactttacaatccggtttaaagaaatacactgggatggacagaaggggtagaaatgatctaagtaagaagtgcggtaatgaaagctcacattttggaagcaaagccttttgatgatttgtttggataatcttcatggtcatgaaatatttgagatagtagaaaaattttttgagaagaatagatatcttcgccaatatggaaggagtagaagagaaattgtttagagacagttaaagaacaatttggaatatggaatactcagtaaggcaagggggccagggtgacttcattaagcagaatctaactgacaagttaaatctacacaattgtaatcagagtctccaaaatttcttgatcatataccattatcagatagaggcttgctctgttgttgcccaggctggagtgcagtggtgcgaccatagctccctgcaacctcaaactcctgggctcaagcaatcctcttgcttcagcctcccaagtagttgggtctgtaggaaagcactatgatgcccagataattacgaaaaaaaaattcttttatagaggccagggtcttgctatattgcccagactggtctcgaactcctagtctgaagtgatcctcccacctgagcctcccaaagtgctgagattttaggtgtgagccactgttcccagcctatctacttatgtatctatgtgctactggcaaccattgtaaaaacatggactaatttattccctcttttaaaaaagataacaaatagtagtcttaatatttttttcttgcattccaaataattatcttgtgcactccactggaacattagcacaaacttttagaaatgaattctttcaatgcctctcacagaattgacaagctatatggaatgtattaatatcttttacccaactccttcagttagcctccctaatactggaagctgtaagatccttgaggacaggattcacctctttgccttccatggtccttaactgtggctacttaaaatgcaattaagaggcctgggtgagtgagagcaccctggcagaacagaactgtgtgcttctgggtcagttaccagagctcctcagctgcttgtgtcactggctaaattaacagtaatggtgattatttaagtctacctattaatgtctacctattaaatcaattaaaggttaatctttcttattaagtatgtacatagaagacagtaatcctcatcttacaaatggagaaagagaggcaagaagggcctcaggctatttctgtacttaggatactaagcaccagtgttaattcacttaatttaggaattaacaacccgactacccctgctatctcttgccttcccctgaaaaatccagatgttcctaatttactttgttgtaccatttcagcaattctcacaattgctaatgaataattttgatatgccaatcaaacacaatctgctagtggtgttctggtattagtcacacgaatttcctttgactagtaaagaatgcaatatgcaatcatctattaagtcctggttgccttacttcctttaaggaacgggtctaagacaggaggtgtccaaccttttggcttccctgagccacactggaagaagaactatcttaggccacacataaaatacgctaacactaatgacagctgatgaactaaaacaaacaaacaactcataatgttttaagaaagtttaagaatttgtgttgggctacattcaaagctgtcctgggctgcttgtgccctgcgaggtgcgggttgggcaagcttggaggatgtgattttttaaaaaggtctaacaaatgctggtgtgcaacaaactacagaatactttgtagcaaatgaggcagatttcagtaataatgtgtgccaagtgttatatatataatatctcatcgaatcctcacaataataggtattataaacatatactccccctttcaacacatgaggaccctgaagctgatggagttggacaatttttccaaggccacatagccagcaagtggcagagctcagatacgaactcagacagttgggctccagagccttcctaagtgctggggaaatgagaaagtggcattttccttgcagtgacctgtgaggaggctgcagacaatacaacttcaaatatagtaaaaaatagttcacatatattaagaactgttatgagctctgacttccaatggaggtgagaaaatagtggcaagtgattgttgtgaatttagaatgaaagctttgatttgtgtttattttgtacaaaaagctagtatctgggagtagagaaagttacagaggctattttgtctcttccagcatcattacttagaatcacttactattgtcatgatttactattattatttctgtctcttgaaggtcataggggcactttttatgccttcagaacggcatagatttaagtaaaactgcaaatgagttgctccatatatcaagttgacttgtattaaggagttgatagctcagcagtaggtgggaaaaaagggcccccctggtggtcccagttatcactgcggtcatgagacattctatatttagtttatttggaagttcgggtgggctcagtctttgatttatttctgacacttcaaggactagtgctatttcattgtttcagggaaagaacaagctcaaaaaatgaaaatagtcactcttggtgtttaaagcttcagtgggagagtgtgaatggcaagttttgaataaagaaaattcattcatttaacagtaattatttgataatatttatcacacacttatatatggccaaggattcttctaggttcctgggatttaggtgtggcccaaactggcaaaaatgtctgtccttatggaacctgcatttcagaataaatatgttatatcattaaattaactagatagaaagggtaggtagtcattattagatcacttaaaattaagtgttacatttaagaatatacttaagaggattacctgtggcctaatcattacttttgtagtcacattttatcacacatttattaattctagatttagcatctattcttgtttagagagaagctggcaaagactataaaagtgtaaagaacaagcttgtgtctataaaattataaacaacacatatattaatagtagaattcactgagcaaagggcattagatatttaaaatgcattttaaaactgatataattgaagacataatttaatttttgataatattaacagtaacaaaatttttttgccaatcttttattttaaaaaagattagattttttaaaaataagaaactttgaacctcaaagagaacaaaaccccacaatttgaatgtaatatagtgatttttatacgtataacttttcatatttatagtcttctagctacaaacaatgcagcctcattaatatagcagattaattcttcaccacgttttaacttccgatctcagaaatatcaacggtaccatatcagtacctgattccaaaaggaccctggcacaatttccatataggcaaaaaaatagagatgccagatttgctgaatttagttttggaatttccaggaagcaaaaacatcatataaacccaatttaaatatttaataatataaatgcaaatctaagtaaacttggggaaaaataaagggcacaaatatcaagcatacaacactttccgttgaaaatgcactgataatgagaaccagtctcactccttgatctgctcttctttcccaagagaggccaagaggaagctaaactcattcatgtcacgaagatgagttataaaagtgggacgcagcaagttcgtttcaagcactgcctggctacttccacattccatttccactgtgtgtcccctcctccccacttcctccctagttcattcttttgtattatttgtctcatctctctctttttcactattgagcacccttctgagggcagagaccatgtctatttcatttgatattattccacagtacctagcatagtggtgctcaatgctcagtaaatgcatgtttaataataaataagttaaatcagatcttatatatttttaatgagcccatatgctcatccataatgaggctgaaggtaaatagcttcgtcttggtccaacactgaattgtgtcactttcctcctggcatttgatactgcgagtgacccactgcttcttgaatcagtctcctcccaggtatctggcatgtgtgctctgactaggtcactacttcctcattcctgtggaaatgcaacaatatcaaacctcccttctttgaactcctgtgttaaagacatcatttcacaacgctcccaactgcttgtgtttgccattttgcctgctttgttggacttgtaagcttcttgagtgagggggtcttacatattacacatctttatacttccaattttgcccaccagtgtgctgccaccccacggatgctctgcaaacatagaagttttgactgctggccataagcggtgagactagagctttgaaaggaaggaggattctcaaacatgcaggaaactcaccatgaggcacaaaagaattgaggtgactgggtccagtgttggggcctacagtatggtcagcggaaaccatttgactaatacagagtggcatcattaaaaaattctctggcttcatccctgggaccctgtgcccagacactgctgtacgggtcctttaacctgagagagccagtctttcttttggtggtccaattggacctgtactactaatggctgaggtgagtgcagtaggggtcctctgttttggctggtgaaagggttgaatggaataggcccaccatgcagtgaagtggagaacatggcagtaagaaaccgttccactgggtgttgaccatgatacacctggccatcctggaaaacagagtagatggtaaggactaggagtcccattagtggggcttgacatgaggacagttaccttctcaattgtccctggggctgatgcagtttagggtagagtgagtcaaattaagattcaaacttatcctcaacatctcagctcactccctgcaccccatctgccatcctttgctgtcatagggagtccaggcaaattgtcattttatctatgcctacctgggatgttaccatgttattccctcttgctccatttgccaaatatcctccttcacggcatttaaaaaatcacccattcattcttcatcacatgtttaatgagcatcttatatgtgctacatttttctaggtgcagggataaaacagtgaccaaaatagcccaaatccttgctttcacggagtgtatattctagcctagatctcacttccaagacacattcttccaattaagtagcaacagcagcagttaatatatgaaatccttgctgacctttatcgagcactaactacagttgaaatactgggctaaatgctcattcataatcttaggtggcaggtattattaggaaacatttttaataacttcttatttggaaataattatagattcacaaatagttgcaaaaatatgtatagggtggtcccatgcgccctttacccaacctcctccaatgataacatcttgcacaactatagtacatcattaaaactaggaagttggcattggtacaatctatggaactcattcagatttcaccagttatatgtgcacctatttgtgtttgtgcatagtgtgtatgtagttctatgcagtttaattatatgtgtagcttcatgtaaccaccactgcaatcaagataattaactataacatcatcacaagactcccttgtgctatccctttaggtctacacccattcccacacctgcctgctaatccctggcaaccactattctgttatcaatttctacaatttcataaatgttatataaatggaataatgtcatatgtatacttttcaggtttgctttttccatttgggataatttccttagggtctaagttattgtatgtatcaacaatttgttcctttttatttagtaatatttcatggtatggatataccacagtttaatgatctgcatgttgaaaggcattttggatagtttaccattttgggctattgtcacgaaagctgctatgaacattcatgtatgagtttctgtgtaactatgtttcatttatctgggatatatgcccaagagtacaattgctggatcatacaataagaccatgcttttgttttaaaaaactgccaaactattttccagagtgctgtaccattttacattcttaccagcaatgtgtgagtgatgaagtgtttctgctttctagtagcaattgatatgatcactattttgaaattttattctttctaaaggtgccgtgatatctcattgtggtatcatagttgtttattttcatttttatttttgtaaagacagtgtctcactatgttgcccaggctggtcttgtactcctgggctcaagtaatgctcccacctgggcctcccaaatcgctggggttacaggcgatcaactttattgcagtattagcatgagtttctgtaatggcttatgatgttgaacatcttttcgtgtgcttatttgccatttgtgtatctcttcagtgaaatgtttgtgcatatattttgccattttctaattggattgtttgtttccttaatgttatgttttatgggttccttgtatattctagatacaagtcctttgttagacacgtggtctgcaaatattttccccctgtctttaatgtgtactttcattctctaaaaaatggtttctgacagagtaaaagtttttaattttgatgaggttgaattttatcaaattttccttttatggatcagttttaggtagcaagtctaagaattccttgcctggtgttgggagctgaatattttctatttttttcctagatgttttataattttatgtcatggtctattttttgcctatggcttttccattgctattatgccctatatttatttatttatctgtacctcaatggatgcaaatatacccattttaaagattggggtaaaaggctgagtgaggttaactaacttgcccacagcaatacaggtagtatggaaggtactgggattgaaatgcaggcaatctaacttgaaactgcagcctcttttttttttttttttttttttttgagacagagttttgctcttgttgcccaggctggagtgcaatggtgcgatttcagctcaatgcaaactccacctcccggtttcaagcaattctcctgcctcagcctcctgagtagctgggaatacaggcatgcgccaccatgcccagctaattttgtatttttagtagagatggggtttctccatgttggtcaggctggtctcaaactcccaacctcaggtgatccgcccacctcggcctcccaaagtgccgggattataggcctgaaccactgcgcccggccaaaaccacagcctcttaatgactttacttgcctgctctaaggcatatctctttgcattccccaagtaaacataaaacacactgatttcaccctctatgtgggacagaacaaaatgtattcagaaaatagaagtcatctaatctttatagaactttttagggaaacctggagctttaatcattatcattgctttgaacaaaaagtacataatttaaaaaataagtgattattttcaatgtcatgcatccctctaatcttattaagacaagagttatctaatcttataaagcataaaataaaaaaatagagatgaaattgagatctaccattaagtaaggttaccactcaatttttgctgatgaagtagtaatggattgatgatgctggagattcacccttaaaataaaaattctggttccagacagtagctgtggtttcctaggacatatcttatctgttatctgtcaatagaacaacggaaattgtgcactactgaaaacagatgtagcctcacattcacagagatggaaaagatgtgctctggaagtcctcactgcgttactgtcaaatgaagccaggaggtactgatattatatattacagtcagcaccaacttcttggcctaatgttcagcactattttcattgttggaattaaaaatctgttctagaattgggggaaaaatgacatgagaaatatcccatcaaaaagctttttttcctaattactattggctctgaaattttggctttagccattagaaacttctcaagatggttctggtgggcattttgttttgtagcaggtcccatagtacaagcttattgcccagagaggatcttaaatgctgttaataatcatacaatattgtataatattatcaccagaagtttactacttactaaattataggagcattggatatctttggaaaggatttaattaaattacaacaaaaaatatcctggacctatgggaaaatgacacttgccaatgaaagaaaacccagtcccaaagtgaaagaccgtgcttatattgacatttctctcaaaataatgagatttcattctccaagttcttacaataaaaaatttcaaacataggaaaagctcagaatagccagagttccaccattagattcatttttaacattttctatgttggctttatcaatatgtctatattaataattctttatgagtaattttaaagtaaactgcagatgccacgacatctttgcctttaaacgtttcatatgtttatcttctcaggatatggacagtcttctatatagtcataacaaccatgtgtgtacattttgtatgtatgcagtaggtgacttgttgccttagcaggttaacgtctgctactggtgtgtattttttgacatggttaattttcttggtgtttacactttcgtccccatggttagttattaaatatatgtaatacaaagtatctgttttatttgttaagatctccttccttccctactttgcaaccaacccctgagggcaaatcaacaaaaatcatttagttcattaaaaacaaagttgctctagacaaaagtacccatttgctgactgctgtttggtattggcttattggtagacaatactaaccacacagacatttataaatacaaatactatttagtgctaggtgtccttttcttttcttctcttcttctcttcttctcttcttttcttttcttttcttttcttttcttttctttctttctttctttctttctttctttctttctttctttctttctttctttctttctttctttctttctccctctctctctctctctctttctttctttcctcttctcttctcttctcttttcttttttggagagggcatctcactctgttacccaggctgcagtgcagtggtgtgatctcggctcactacaacctctgcctcctgagttcaagcgattattctcctacctcagcctcctgagtagctgggattacaggcagccatcaacttgcccagctaattttcgtatttttagtaaagacaaggtttcaccatgttggccaggctggtctcgaactcctgacttcaagtgatccacctgcctcacctcccaaaatgctgagattacaggtgtgagccaccacgcctggccagtactagggtttttaatttggaaactatagtctgaatttaggtggggggacagtttgtgaaatttctgacaccgtctagttttgtgtgtatacaaacttttaggaggcagcgggaagagtgtccataacttccatcggagtcttaaaagtgtccatgaccctaaaaaggttaagaataattgatttaagtctttcaaaataccctttggaagctggaaaatactaattggaataattatttggaatgttatttggaaaaactatttggaatatcttccagcatccaaagggtatgtatcttgaaagcctaaataatatccaaataatactaatagcattagtatcaaatgctaactgacggaaaggaggaattccaaaaggacccgtctagcccatccagttgacagcctggtgccactgaaatgggttctggcacaggcaaagaacagagtagaaggcagcacagagcattttactcacactgacaagttctcaattagttcaagctcttcaggaaaaagatctgaatgtcactgcagatggtccaactctattcagtgggcagagactgggcagggtgccggaggtctgccctgggcatcaggcaccaatggtgcccaactgtgtttgttctaactgttgcccgactgtgttttttctaactgttgcccgactgtgtttgttctaactattgcccctctgtaggctttggtagtcttgagggtggtttacatctgtgattgcattcaccttgaaaaaacacacaagggggaagcagaagaacccaaaacaaataagaaaaagtctcctttttacctgactggtcattttggaaatgggtgcacttccttgtaagtaccaaaggaaataaaggcatggagaagtagtaccaggcacagtgcgtggtgtttttaagtagttgttccctagttttagaatgatcagtatctccttagcttctttgtttcacagctggaaggaagtgaagctcaaagtgatggagcaaccggatggtgtaaagacagcgtttactcagtgagcagggctgagattagaacctgtgttggtaaaatgccatttcccatcacactttgttgttttataaatatgcggtgggagaggacaggtgtggaatacacaaatgcaaaagaacaatcaaccagtgaagtccacctgtattggggggtagtttgcttgctgtgctttattttgtgctagcttctgttgaaaaatgtacagtgagagagaaatcaatagcacttagcattcaaattacttgacttacatgcattattcatttaatatttatagctccataagcattctcaatccattttactgctggagaaagagaggctcagtaagaagagtaaatagcccaaggcctcagatgcaataccttgtaaagttgggggccatacccagggctgtctggctctcatccctgcaggcttgaggttataggtcaggtgagattggagaattgttagcctctgggtggacacagactttcagaccattggagagcactgagttggagaaaaaggttattttcctccatttgagccctattatagtcaatgcacacattcttgactagttttacaggaaatcaaattttagtaagttgaatttacctttattgccaacggatattcatttggcagatgattataacactttctttttacctgctctctctattgaatacaaaatccacaactaagcatttaaacaacctgggggagctaagggaatttctattttgtttgttttcttggtaatggaacagttatttcccaatgagttagactgtgacatttttatttctaatattaaatattaaaaatagagtataattcaaaagggtaaagctatgggatgacactcagaataaggggaaatattttaaagagtcctgactctaccaatgactagttctgtggccctcactagttactggaggactctaagcctcagtacctacacatattaaaatgtggatgacagctatctcagagggttgtttaatcatcagattaaataagatgacattaaataagatgacatacgtaaaattcctggatccctacaggcactcaataaacagatataagaaaataaaataagaatctccaactggagcaattagctatctaaacttggagatggcaggtagccaggtcagaatttctacctttgaacaaatcctgaattgctctgaagcttaaggccaagaatttcagtttatttcagtttcacataaatatgaagaacagagcaagtcaatcattatcatcccagatgggaacataatctgcttcaatttctccatggtcttatcaaatgatcgctattctgcatttgcaagtggttttttcccccaacaacaacaaaaattctctcccacagatcttcattccctctcctcctccataataaccttgttaaaaagcaccactttattataggtaattgagtggattttctaactttattagctaattgtggtagtttgcaaaatggctgcaattcttctcttccctataatgaagtccttttgcaatggtgacttttcaggtccctctatcagtaggtaaagtttgttttccttccccttgttttggattaatcttgtgacgctttgggcaacagaatatggtggaagttctcagcttagtcctcaagaagccttgcatgcccgcagatggtccttatacctctgcccagctgccatttgaacaagcctggggtgcccggccagctgccccccaccatgccagccatcatctggtcagaggacagaacttacaactaaacagggaggcagatattttggggctgtgtatgtgcatgggacacgcccaggtgtttttctcaccgataatcttgtatggacatatgggtcactttagtaatatctggataacctatttccatctgtaatgatgacagcattttgccttagcaattctcaagtttcacatagggaaactgagacagacacatctcctctagtataaaagcttggctaagatgagagccaatagtttataagctctgctgaattcatttattcacaatgttatagtcacagaggaagcaaaccaacctttgaaacataaggcatagtagagggaggaaagactaagagaaagaaaacagttttttgttaacttggaaaacctacaaatatttattctgttaatcaagccccaaaccatatgccctcttaaaaatatgtttgtgaatggatttctaagatccttcatgcttcagcatagtaacttgagtttattagatgaatgaagaaattaaaactgcctggttctttcagttgataacctaataaataaggaaaatcttttttctctgttgaaatcacaaaataaaattatgatcataacatatttaagcagtcaaaaagcatgatgtcttatacaattttaatctgcctggaacctttccatgaaagcatcatcagttttatctaaaaatggctctcctgctgttattaaaccatgtgccttgctgagtactcactgcataaagaagagcagattcatttggaaaataagttgaatctttatcttttcagatattaaagttggatgcctttctctctgtactgctataaaaaacaccttcatattacttgggtttattttaagttgtttaaaaaattttgaaagcataaactaatatttatgttttctgaccacaaaagctacacaagttgactggaaagtataggcgttgatacggggttggcagagccaggacaaggatgagatgaatgtctcactttgtctcctggacaaaatttaaggcagtaccaaaaaactcagtattatagataaataacataatgcaatatttcaaaaaataaatattagtgcaaaataaaatctacaatgaacaaaatgtcaagattttaagtaaagacagctcttaccttgcacttgaatcttccctactcatcttaccctaatcctggccctggtttcaataaaactttatttacaagaataagcagctggttcatgagctgtagtttgctaatttgtttctttaaatattgcattaaaatatttattttgatgaccaagattttgggtacccccttaaattttgtgcctgagtgccatcctcaccttaccctaattccagccctgggtgttatcttctattctaagttcaaatggtaagctaatgaaagttttaaagcaaatgactgataggatttgatttaagttatacaagtgggctttggttgctgtgtagtttggcgggagatctaaagtggggactgggagaatagttaggaggctgatgcgtcagtctagtgattttgctctggtccagaccaagtcaccaaagaccattcagatgtaaagatggtggccacttccctgtctgcatatctacgtgacatctcagcatttgtcttactcctgttgattctctcatggttgtccctctgctttactgacttctcagtcttgggaactctgccctcttgtgttctcacacaatcccttggccttaaattccatcaacagaatctctagttctgaatttgtctcctccaaacatgcatatccaattccaattgccaactcaccatttctattgaatgtctagtgggcataataaacttaacaaaaccaaagttcactttcaaagatgtctttctctctgtgctgtttggattagttcaatcacaaatttagatattacaaaacatcttcacatttcttgtttattttaggttacttaaacatttttttttttttttgagatggagtctcactcggtcgcccaggctggagtgcagtggtgtgatcttggctcactgcaacctccgcctcctgggttcaagcgattctcctgcctcagtctcccaagtagctgggaccacaggtgcgtgccaccgtgcccggctaatttttgtagttttagcaaagacagggttaaacatttttgaatacttaacatatatgtgtttaggctataaaagcaacacatttactggaaattatgtctattcccaaacctgttactcttccagctatcttccagtagagaatggcactaccattctactcagctgttcaagccaaaaaattactgcttatttcttttcttctccttttctcccacatccaatccaccagcaaatcctgtcaattttgccaaaatgtgccttcatttttttaaataaaatcagcatcagcctcagtaggcctactaagggtatagcttccacacattagggtagagtctgactcggtggaaggagcagtcgttgggagggaggggaagtgtgtgtgagtaggagtgttaaattcccaggtcagggtatagggagagactggcttggctttggggaggtgaaagctgcagggtggagagagctggaatatgcctgggcctctccaggtgggacagagactaggagatgtcccagcttttacgcttacacacacattctctctcatcctaccagctgggtctgcacagctggacctgggaccagaggaggaaatacgccagcagatcttagtaggtacagctagttggtattagagggagcagagtgatctcagtgaagatgtgcccagtcatcagtctggcaggggccagagcagacagggttggtgacaaagctcagctggagctcagcatgtatgaatttagcatccatggcctacacagggctgacaccagctggcagtgtacaaaaatcacagggtcaattttccaagctaagcgtatactgtacactcctctgagaaccaagttcactaatgcagaggccacttaaagagtagttatgcctacaggtcctgcttacattgaccaaatagagtttgtttcattgtttgctttgttgtttaatttggctttgagaatggtttatatgagagcgtattctttttttttttttttttttttttttttgagacggagcctcgctctttcgcccagtctggactgcagtggcactatctcggctcactgcaagctccgcctcccgggttcaagccattcttctgcctcagcctcccgagtagctgggactacaggcgcccgccactgtgcccagctaattttttgtatttttagtagagacggggtttcaccgtgttagccaagatggtctcgatctcctgacctcgtgatctgcccgccttggcttcccaaagtgctgggattacaggcgtgagccaccgtgcctggccagtattcttttttttttttttttttttttaacatatctgaatgaattcatcaatcgtctgccttataaaaaatcagtggatttattcagtgataaaaaccagtaaattttaatttagtaactactgattttgcatgctttttgcatatcaaatgtaagttgtcaggaccctattaatatgaatattttatctaaatgttacccatttaaaaattataaatatttgtcttactcatacctgcattttactaaactcattatctatagtataaaactattacgtataatctctctttcccactgaactatctgcagagatcaaaggacccattattcaggccagatgttttcatgttttttaaaattaatcttgtttgtataaagtatatttagcttattttttgacaagtccctgatattccagacttaatgggtaccaccactaaatctgaataattgatggaaatgtacctaaaatggcagcaaattgagcatagatcctttggggtatatttctctgtatgcagggtgtttgctattgatgggccagcaagtgagcctaatccagacgtgtcagatgatggagaagggcttataaccatagacactgtgtccaggataacagccccgaactctcttccatcctttggagtaggcagacttgtcatgtctgagctttctctctgtaacatatatttactcaaaataactatgaacatctgtgtatgcctctccagtctgcaaagaacttgtaatatatctctattaacttgttgcttaggacagcagttgtcaactttaaatttttttctgcaaaacatgagggtgacattgacatgtgtgacacttgtgcatcgatgtacccatcatgtgatgtgtttaatccacagattcaatagaattttacatctttgcttccttcctacttgaggaagcttgttggaactcaactgagtgggactgaaggtattgagatcactttgaaatttctcttatttgtaaaagtaagttgatgaaattgggcacttgagtcattgtgaataataaactgcatctgacacatttcacaactaaagacattcctgttcacctcaacatctcagttgtgaacttatagcttagtgagtaatagcatctcccattgaaaggaaaagatttacatgttgagaataaggtggagtgttagaaatgccaataaaagtaatggcatgtgtggtggtggggagaggtgatgctagaattgctgatttctgctctcttctggaagccaataaataaagttattaggacagtccaattcatgtgaatgcaggtagaagactggcttctgagggatgagaacatccagcctaagtagatatgtttgtaatttttgaaggtaacatttattgtttactagtgcctggcagggtctttgtatttttacatagattgaatcattatagtaaacctatgagatcagttttgttttcatccctatgttacagatgggaaaaatgagggaagtgagaaagggaaatattcaatcacttgcccagtgcgtatgattgtaagtgaacaagctgagatttgaactcaggcagtctagattcaaggtctgtgctctaatttatcgtgctgccctctatctccaattctagcctgtttaaatttaaattacagtcctcactgttttcctcgcttgaccttggcttatgtatattttctctatatttttatgtaagcaatatgcttgaaacaacaagttcatgtttttttttaaaaacatgacatttttcatgttttgcctaatgaatacttgtaaatatcagaaaataaattctttatataaaatatttgttattattaatgctactttttgcattaaaaattttctaggtgaatgactatattagtattctcattctgtgatttctgaaatctaaaagtgcatttactggaatagggtctttttcatgcattaagcataaattggaattttcaggctaaatttgaacaggcatgaaactatacaaggagaatcagaaatatacagtgcttaaaggtgagaaaaaaacactctgttctttctattttgtatagctttttttagatgctcctcatgtccactggtgaaaagaatggtttaagtattcaagctccacactgcaaaggtatggacagaggggcaagttactaaggacataaaaaatgcttggacattgtaatacaccagctcctagagattaccttagctccagtatgaatataatctatattcgcattcatttgtaaagaccaagctatctggaatttctgccattttaggaatatcttgtattggtggttcatgattgtaaaattattattatcattttagacttaaaatttatttgctctgcatatagtatgctgcatagttacaactaatattcggggctatgattttgcatagtttagtttgtgagtttatggctgtaagagaaaaatagggacatatttcatatgttgtagtaaattcttcacataaacatggtgtggtttttaaacattgtggcaaaaaaaatgtgttttaaaaacatagtggcaatgaagggtgtggaagagatggggcttaggataggggtgggatgggtgagcactttccaggtgagttccggtgacagttctcaggccaagtacagagcggcatgggggtggggacagtggaggacatcccagcggcccaagcaccccatggctctggatacaccccacaccgcaatcttgggcttcttatattgattctgcaagaaagaagactttgcactgatgtttgactatgaatcacaactacaaacttttctagtctgcaaacaatttctaaagcagttattcttgtccagtcctctatttttaaagaagaagaaaaggatccctagagaagtgactttgaaatgcacagggcactggacctgggtcagatgattcaatcagtgtcttgtttctgcgtcttcctacctgtgtgatcttgggaaaggcattggcctttctggctacagcttctccactgatagctttgtgatcatcctttctatggatgctaggaagattaaatgggacaatgcacatcaaatcaccatggaaatgatgtacagctgtacaatcactgcttcaaagcaacttactctaggcacacagctaatcagaatgcaaggaattctggccactttgtgtaactaatagtcatatcagtatgttctggtgcctataaatcttcttagatgcttcttttcctcacaaactaaaatataagccatttcagtttcttgcttgtttgtagactcccctcgaagaaaatctgaagagaaattgtgcttttacccaacagatcatttccgttccctgaaattgcccttgccacaaattatcacaaaaactggtatcctcctcagcagcatgcagggggctgtcacttcagggctgacacactttctctccttcagagagaaatttctctaaagctctgaatgctgaattcaaaatatcagtgctgtcaggccaggtttgccttttaaagaaaggtcattgctgtaagggacggatctgtgtgcaggcctcaaattgggtgggaatagattgacagacatactgattcaccagaaagattttgatggataataacaacctttcctctttcaagggtgtgcttaggcagataggaataagatataaacagagtctctctattctctctctctccctcttcccacaatattacttccttggcatgtttagagtgaaaataagttttcgtggcttttacagccttaaaaatatggctgcaaccaattttcccaggtatgtatttcccactgcaattccttccctcatcccaaaacacatatatgtacacatgcacatacactcacacacatggagggaaaggagttatcaattctttagttacattacttaactggaatactatctgtggcccattcccctgtagaagtctgccaaatttccatccattctttaactctcaccattttcatgaatcattccaagattttcccagataaaattaatttcctttctctctctctttccacacacacacacacgcgcgcacacacacacacacacacacacacacacacacacacacacagagtctccctgtactgtaggagggttcatagccttctttgattatcaatgtatttttatttctgtttccctactaggttgtgaactcttccttgacaaggagtctcagacatctatgtatcccccatagaaactaagcatttattaaaggtgttcacagaaatatttagctgttacaactcttcaaagccaccccttttttctaaatctcagagaacttagagatggtctgtattagggtttcctatgtcttcttcactggaaattttggccaaagaggacaagactacaaacaggtctctaaaactgaagaagtaagaagcactgggaaagatgagaaacatgtggacatccatggctatgttttcatgtggcaggtgtccctgacacaaggtacagcagcaagcattgcccagaacatggctactggcttagcaatgccatggaggggatgcagaaatgggacattaatggcaatttaagggcaggacaacatgtacatatacagatacaagagaagaacatttctggatttagatgaaaggggaaaacaaacaagatgtattaccagtaggaaaggatgagtacccagttaatccattagataccatttatatttcaattgttaatgccaatcccttaagtgaacataggttctcacctctatataaatcattaacttctattagtagatgaaaaaatacttgatttcacaagcagcacaaagagaaggcctgcaataaacaaggttatagggtatctcacttgagttggacaatatctattttatagtgaatattccaataacgattgtgaatcctgagtttgaacttccttcctcttcctattggtggtagtgacagggaacatgtatggaaggcaagaaagaaagataaaagataagatgaagagccaactagccaagccaagacagccttattcactagttctcataaataaaaatggtgctaacattaactaaagtggcataaactatagtaggcagtgggcaatcattagtttacgcaatagactaacaacccattaaggtagatattattatcttcattagccacatggggaatagaggtgcagcaaggttaaacaacatgttcaaaggccgtccaattaatcagtggtactgccacatctgtctgattctaataaaaaagggaaatctgccaaataagaataatacagttcaaaaagtcagattaaatgaattcagagaggtagcaggagattcagtgaggaaactgagttaaaaaacccctaaatcccctgaaatctaagcacccaaaggagttggatggcacttatggagatactttcaaaacacaagagaaaaagttgaggtaagaaaaagaatcaatttggctaaaactagaacctacaccaacataatagaaagctaggtaacaaggcaactaaaccaggtcacttaagcagaagtgaagaaaataaaattcacctgtagaaagaaagcccagaataggagactatttttaaatgggaattagttggaataggataagcattatttaattctactgggcaggaggaaccgaggtaaacactgatttactgacaaggaggaacatctaattaaagaggacacttttaagattaagaggttagggttggttattgggttttatgtttttaaaacattctataaaagggtcaatctgtattcagtttcacagactgaatctgtatgcagtttcacacagaccacccacgtgtgttggcagatccagaaagctagaatagggaaggaaatgactcaaagttatttaataaagctgatttcactcaaactgtcttggcctaaagatatttattccaaaatgagagggcttagtgaattttgtcatgtttgattaaaaaccaaaaaaaaaaaaaaaaaacaaaaaacccagtaattctttggaaaacatgggtgatgggaaaagtggacatcatctagaaaagttccaaggtcaaggatcagtcagaccaatttaaaaactaaaaacaaatcagtgtcagatattagccaacttgtaaaaactgcaagtgttcagaggtttggaactatagctaaatagctttgataatcagggtacacaaaactttgtacccttgagatgacggagtaggctctttgaatttactttcatgataattgacgggaagtattcaacttttttttttccagataatatatgttgatctgtagcttgaatcgttacacacaaaaatatgttgggtattacaaaattgaaagaaagatagaaaatactagtgcacttttaaaaagaaagcactaatgttataccatactgctttttaaggcactagaaccatatgttcatgataggggtgggggtagggggttggtgagaatactatgtttagacctcaatgtggattttctttcagaatttgaaaatcactgccaaaaatatggtctagtatacactgacatttggagagagtacaactggatcaaaggcttcctcaaacataggtttcatttggtcaccagtactagcatgttcaagcttctctttacaatcaaacatttcttaggtccacttattcccagtggcatgtggttcaatggttcaacaaggaaatatggacagcggaaagaaataagatttaactactggcacagaaagaacttgtccaattagcacagtttgccaggtggttatcttggatctaactccaagaatgacacaatataggagctatccctccaaattaggtctgaattcagagcagtatgaatttgtagtaatcatccagttgctagctattctattcagcatgtcatgctcacaggcaagtctcatggccaaggagcaaaagctctaaaagcagactgcggggttgaattctaactctggcggggtacaactggtgacataacatacacagcaaactgctctaaaccttgatcctcatagggaaaaaggaatatggggttttacctcgtaggctattttgaagatgaaaggagatcattcatatagagggtcttggcacctggtaaatgctcaacaaatgtaagcttttattggcagattctttggcaacagactcgaaagctgaaaatgtaagaaaccaaagatgtaatacttccagaagacaaaagcataatggtactaattgggtctcaggagtctatgttggcagtaaaggggatgaatgctgaaatcatcctgtccactgggtaagagaaacagagcccaaaatggatttctgcaggtacccagcatggggacacttaagtagggatcacacgaagaccaagaagaacaacccagtgagtgaccatagctaccattttgctgggccactggcccatcatgtgcttagcctgcagttgtgaaccagccctgataatctcccacgcccatcagcctcccatcccagagaaacagcttgggtgtgatgattagggagcagcttgtggctatgaaagggagagagagcaaagctaactggccaaatgggaattgaagctgtgaccttggcctcattaaaacagcaatgttctggagtggatcaatttttcacagacagccaggccatctgcagagaaaacaaaacatggcacgcgcacacacacacacacaaataaaaatacagaaacaaacagcaactaggattcacaaccgaaataaaaattaattcacaggcattgtaaacatcagcttctagtgtgtgtgtgtgtgtgtgtgtgtgtgtttgtgtgtgtatgccagcatcaaatagctgtctataaagtcacttctgttggcagggttgaaatgcttctgaagtggagaagtatgtctttagcttacatttgaagagatctcatagttaagtggtcaacttgtattgataagacatctatactcctcacagataaataatgtgccaccttataaaatttgaaaactggaaaattagtaccttttcagaaacaagctcagatgtagacctaatagtattaggtagcacagatctgaagccccgattacctcatctgcagttatcctatggtatgcaagaagccctctaagtaaagctacaacaccctaagtggaaagcacgtcagcattaatcacatctaattataaagatgcgaatacttataatagtacttattaggtactactcattgttttaagcatgttacatatattgcctacttcaattctcataataacccaatggtgaaggtgatgttatcattcctattttatgtacaaatatatgaaacagagagaaattagacaactcgccctaggtcatatggtgaatagaatgaggattgagactcaggcagtctaactttgaacccatgttcttaacagcacttcacattgtagccagtgaggcctcctgggaaaaacatgacattagacagcaaggaaatatggtttgctgctggggaaccccccacgcccaccatcatcaatttctttctctcttttccccgttttctccctatagtgttagtctatgggaagcaaactttcactactttttaaaattaggtcaaaaggcaaaacaaaaacataccgctgccagaaaccctagagataatataaccaatgcctttattttgcagatgaggaggtttagggtcaagctaagattaggattgagggccctaaaaattattgggatcatcaaacccatgacagtgcctgcattagcagcatctacccgctcctgattcttacaggtttctctatgacatgcgccgcaggcttcagcagctgcgctcttataactcagttttcattcctagtttcattcatcgaccacacgggtttcctcccctgcaaatcttggttcttctcttccatttgggcagtcctctgtgagtgaattatttcacaagtaaattgctcgattacaggagatacccacactactttgttccataaaattatactaagtgttctgcatagagaggaatttcaaatctttttgaatctttattgttaaagctaattggtagtaccttatatttaatctgcatgtgattagaagttactgactactatactctcatgtttcatcagttttggaggtagggtacttcctctagctcctggctttttgtttggtgaagataacattttagaatttgatattaccatggtaggctgaatactggtctccaaagatgtctgtgtcctgtcctaaccccagaaacctgtgaatatgtttgtttatatggcaaaagggactttgcagatgtgattaagttaaggatcttgagatggggaaattattctggattatctggtggggcccaatgtaatcacaagggtcctcataagagggaggcaatggagttagagaaaaaggaggtgtgaccatgaaaccagaggctggagtgatgcactttgaagatgggggaatgggacgcacaccaaggaatgcagctcaatctcactagaagattgaagaggcaaagagacaaataaattctcctctgcagcttccagaaacacaccccaaccaacatcttgattttaggcttctgacacccagaattttaacataatcaatatgtgttgttttaagccacaaatttggttgtaatttatactggtaataataggaatttaatacaatcacccttgttcagatcctcgtgcctattcaaaattagcatccatgaaatcagcttttcctctttgtagtttatctcaccagattcaatgatcattcatccattcagttcatttaaccaatattcgtgaagcccctgctatgtgccaggcactgtgattatgtgagcagaacgatgagacaaaccttctcttccatcctgtttcaaccttctcttccatcctgtttcaatatctgccaaggaaaaggcaacccttcccatagggcatcttacttggctttggtttacccacagtgttccaacttcagacctgaaaatgacttatcataaacttggctcacctcgggctgcctcactgctcaccccccaaacttggacatgtacagctaagttgtaagcctgtttcccttgaggacagaggccttttacactcagggccagtctcagataacaaagtacacaagacttgtctttgaaatctttctcaacagcatggccagaagtgtgtccacactctcctgtgtgctgtagctcattgacgttctgttaggacacttaatcacgtgcaatcattgactatgatcacagtagtaagactgtcttttcccttcataatcctcttgagattggggactcattcacatatgtgtcttctttggtgcctgactcatgataggtgctcaagaagtgtgctgaatggatgcaactataagctagtgctcatcaaggataaatatccctgtgtgtgaatgcatatcctcatgatttaccaatgctgatcaatagtcttcattccaatagctttctttccaggtgaaaagttgatctactgaagttacccaaatggctatgctgacaagcttgatataaaatatcaaatatcagtagaatcttgagcttggagttgagtttagacttttattccaagtcctgactttaacgttgtcattcatctatcatctttgtatacttgggccctggcacaatgcctggcatatagtagttgtacatggtatgtttgtggaataaacattccaatgtgacagctgatgcttgaaatgctgaaatctcccttataccctgtatccagtctcacctgctggccctcaaagttgcagcctcagagccaaggtgttttgtgagtgattctacatctatgccaaactatgtgtctgacttttaaaaattgccttattaaggcaaaatttacatacgagtcactcatgtttagtgcacaatttgatgagttctggcaaatgtcaaggtcgtgtaaccaccaccaccgcactcacgatacagaacatttccatcacttcaaagaagtttctccatggccctttgtaatccccaacctatgaccccaagcaaccattgatccacttttggttattacagtgttgccttttcaagactttcatataggatggaaatcatacagaatgtagtggaatcatatagaatgtagcctttgatatcccgctcttccacatgtttctgagatgcattcgtcctgctgcttgaataagcatgagtttgtactctgtcttgcttggacctttggcttcagtgtgatcctgatatttggcctggctgccttgcccttcagcacctgtgtgctcccaggaagctaagggttcctaaaccacagccttttctcctgtgtgagagaccatgacttttgaccacctggagaacatggttttctcctcaactggttagtggcaccacttctctgcccattcgattgctccattgtggaatctggaggttctcctccatcttccctctcccttagatatattatccatgaatttcattctaggtaaaggaatggggcatggcaaatgatggtataacatgttgttctaacatttgtccggcaggtctgggaatcttgcaccagctggtaattctttgtgacctccttgagagtagctgtccttttttttcatttacctatgtataccctttgaacctgcccccggtgtctccaacccagcttataatcctagttccatgattgcaatgatgtccaactgctttgcccagtccagagttattccctttggccatttaaatgcctggcacaggctctccgtactcacacggcaatgcaagcatcagtgttcactgtggagacaaacaaaagggacctaataaaccatgtctgcaacatgcatgtgagtgatcatgccctcattttctcaggtccaagctcaaaaaagccactttccttacaaatactcattgcatacagcctgtaacctacttatcacctgtgactcatattagtttcttgtagacagataatgtagacaaaacaaaacaatttttaggtaatgcccaaatagtccattcaccttgaaattataattctaggccttacactgtgtaacactgtctcaaattcagaagtatggaaaaataagtatctatcaccccagaggggaaaattcttcacaaagcccatccacctgttgttttggtagtatgtgagaagtgagctcatgattgaacattctttgtaacccgaggtttttggtggcatttcatccagcctaaatagccttggacagaaaactagaaggtaacaaaactaccacaagctgatccattcgcattctaaagacgtagacgttgataggaaggcaggtagatgactttcacaccatcttcacaagagcaaaaaatatgttcaaaaatgagaggccaaattaagaaaggttaaattatgcctaatggtctctatttcctaagcagggaagggtgtaatgaggactctttggaaagtcttccattagaaatggcacttgaagtgaacaggtttcagttatctgtaaaatgtacttatttataattcttattctgtgatgaggctggataaataaggtatcagtgcactaattggtgaaaaattttattcactacagatttatggagttgtctagtgatgtgaattcagtcatataaacttcctctaagaaaccacaagaaggctggtggataatgggtttcaactcccctgccacttacaactggtgggtggaggttgcctgagtgctgtgctgagagcaattttgagttcatatctggctggactcagtggcagaggctgctgagattgactggtgatgtcttccacaggtatgggagaagggcaccgtggcttgacaatctcatgtttaacattccaatctaaaggtgccatacttgatactgaaaaatgatcacaggtagtcatttgttctaactgcccctgcagagcctaaatcactgtctcccggttggatttctaaagcctcgtctgcaattatgacaagtgggccctttcagaattatttgtgcaagacctcagactgtcagattcaatactgtgaaccagaatgtgtttctctctaaaccagggaatggatcatttccatagagagagcttttattgaagtcaaattgctatgtaagacactgcaatgaacagaataaaaagtctttgtggttgtcaaggctacaaccaatataaaaaaatgaagatggaaatactaaaaactaatacctgggaaatgtggagtgctatgtgtggttaattctgttacagttagatcagtctgactttatcctctatttgcagccactacaacctatgtgactcattttggccttcaaaactctagtattattttctcttgtgtttggccagtctaaaaccctttattctaatgtctcactttccatcccaagtctttctttattcattcaactctcttattatttcttgatcccaaatactctcatggaaatccttctcctcaagtatttactttctttagtctcttttccagattctcacttctcctatttggaaaattcctatgtttttatcccccaccttcagagcaccacagacaagactcatgctgcttctgtgttctttgttcttatctctctgcatttccttcccagttcctcctcttttgaaatctgatgtggagacacagtttcccttcacctccttctctttactcttctccttccttgcaactgtggtagttgaaatgcgtcagtttctcttttgcctcctgcttcccatccccagcttctgtgttccgcatccaccgttacctctcacctgccaggtggagctgaaccccttccattgtgtctgccatccctcccctcccacctcctcagggattcactagggtgacactccctctggtccttcagaagctcctgggtacctgccttctgtctgacgacagtttgttggctggtggttttgggtttcttccctctgcagtggctgaattactgcccccatctctggcttctaagaattgcctctcaactccagactataatctcaactcaatcttaggagaacctttaaacaactactgaagaagagtccgtttacattcagaacatgacagatgcccggctatgacctggagagtggtgcatctgtcgtgtattgagtgctacgctttaggtggaaactcaacctggcactccatcgtccaccattattgttttaaatcttatttcctctatgatcctgtttgttgtcttattccttctcccacaatctgatttataccctcagatctactcacagttctctgtgtattctttttttcatgtttttattttttattcattttaccttaacttttgggatacatatgcagaacgtgcaggtttgttacatagacatgtaccatggtggtttgctgcacccatcaacctgtcatctaggttttaagccccgcatgcattaggtatttgtcctaatgcgctccctcccctcgttcccaccctccctgtgtattctttgaacagttatacttgttttgactttgcttaggctgttgctttcccttatccctaatctccataaccccaaatcctgctttttcaaggctcagctcaaacactactctttccacaaaatcctctcagatgtcacactgcagaaccctcagtcttttactttctttctttctttttttgaaacagcgtcttgtggcgtcatccaggactggagtgcagtggcacaatcccagcccactgcagacttggactcctggactgaagcaattctcccactttatcctccccagtagctaggactacaggcctgcaccaccacacccagctaattaaaaaaaaatttctgtagagatgaggtctcactatgttgcccaggctggagaacttcttatgagtcttaaaatgtccctgattcctgcttgtagtgagagttatctgtgtcctgctagactgtgagttcccaaggccacaaaccatagcatcccccaaacaatgtacatcaggcactggactgctcctacctccattatggaaattacctcagcctttgcccaagctgccctctggcaagtagaggtcacaagtattaaagaactttcacttgggttgatgactcaaaatatcagaacacattcctgggaaaaatgcctatttacgtatttgtatccattcacaaaggtgatatctctacccctcacatttaccaggttgataagtggtggtggggaagctggctcatttgaagatgatcagaaccataataaaacaatagctaatgcctgtttatgtgtttgtatccattcacaaaaatgatacctgtacccctcacttgtgccaagttcataaggtagtggtggggaagctggctcatttgaagatgatcagaaccataataaaacaatagctaacatttattattactatgtcctgagcaccaagttaaaaagcctatgaggcaggcactgctattatccccagtttacagccaggaaaactgacactcggataagttaacaggttaggttaattgttctctgtttgcccctccatatcaaatcttcactctcttcactctgctgtatgctccaggaggccaacatttaggtgttgaatcaatgatatcctgccctggggcttcctattggactcaatcaatgggagataccagtgggagacccaggagaccagaggttgggaggagagagagctcggaatactgattttcttagctcccttctgtctagatgtaaaaggccaagggctggtttctctccccaaggccactgtccagcagcccgtttctacagccacaggtatcagagggttccagtttccctctctcccttgaaccttcacgcaacgaacgtacacaagtgctttgtagacccttgctggtttcctggaactctactgtttacaagttgaattgtgtcctctcaaaaaagctatgctgaaatcctaacccccagtactttaggatgcaatcttatttggaaacaggattgttgcagatgtaattagttaagataaggggtagggaggtcctagtccaatatgagtcgagtccttagaagaagatggtggtggaagacagagagacacacagagggaatgaaggcagagattccaattatgcagctgtaagccacggaatgcccaagactcttggtgaacaccagaagctaagaagaggtgaggaaggattgattcccttacaggtttcagaggtagcatcacccttccagcaccttgatttcaggcttctaggcttcagaactgtaagaaaataaatttctgttttaagccgttcagtttgtggtactttgttatggcagccctgaggaacaaatacatttacttatgtctttggaaatagtcctttcattaaattctcttcaattatttttttgagtgtgctgcatgttttctgctgggtccctaaccttcctaaggtgaaaaggctaggaactgaattcagggctgtgaaggtaaaactcaaacgcttatcctttataataatactaataacaatcatgggtaaaacttacatagtgcttatattaactcccttagtgccatttaacctgacgactagggctgcagactgtatttttaacactgatgacatgcctgattttcagaccaggtgggtctgtgttaactggcagagctgtgatgaaaagtgagctcttaagtgagctgatttcctgaagaggcacagacacacttggaatggtacaagtgaaatccagggcccacaagggtcaggattttaaacatgcttgagagtttctcatgaataccatcagaagagcagctgggcaagagctcaggtgctgacctctattaccatcaaagcctaaaactactggacagtaccctcatttttaaggtgaacagggagagacttacgaggggaccaagacttttttgaatacaaatagactggccacttgacaagctggaattctcccagatgcaaaagaaagagaaagcaaacggatgaaagatgcaggtctgaacgttttcctctgccgcacaggatttctctgcctgttgtcccttccggaccagctcagtgcctgtgtctctacatatcccagttcctgccctagggaagcaggtggaggaagctgctgtctgagtaatgactgctctaacatttcttttaaggatgacactatttttagaagtgactcattcatataagcaggtatgggtgaaggggcgggaggctctaagtgacaacttaactcttatgtctcagtgcatttatatttattcttgtactttaatccttcttttaacgggcaccacaggtcagttgtgattcagggcaccaatgaaaacagacatttctctggaaataatttaaagtgttttccatccagatacttcagaagtgagaaagttctcaaaatataggagggagggcaagaaagggaaaattgggaaggactgctgtcattttgaggagggggacaggtgagggagcagctaagtaaagagaaagattgagggaattctacttcagatgtctcgtgctttcctgtgcagtaacagggaaagcactgtattagtaactggatgatttagaagccttggagtgaaagcaaatcattctgaaaaggctgcttcctgattcggagactccatttttcctcttatgaaaggaaagtgtattctagaacttttagcacaaccaacacccccagctttcaaaccttggacactgggcaaagcactttataggttatcttatttaaccctcatgaaacttttatgagacaggtagtgttatgaccccattttacagacaaggaagctgaggcttggagaggttttgtaatttttttaaggcaacatactaataaatggctcataactcatgtctgtctgagctcggacatccagtaattctggcccagtggggtatggctagtacaccagagcctgccagctagtgttgctgctacaagagctagtgtttgaaatacttacaggccttgcatataggatttattgctttttgctcttgtgagaaacttcacctgtgtgagtctatgggcttgctggttaagagaaacacggtaaaaaatcttgccattaccagcacttagacttaaatgaccttttttttttttgtgattcttcctcatccgatacaagttaattcacccatgacttatctattcccatattaacatatttttgcatatttgttatttaaccgacacctctaatgaccagtccttaaccacattgttgttgtagagtatgaatccctaaatatcattgacatctctgcataaactactagataaagtccccagcatcatatccatgcagggtcttgctttatcatcttttggatggttaaagaaatgtcagaatttattgtaaaatcatcacgtccagggatatccttcttctaagtattttaaaagcaagaatgaaaaatacaatgttggaccaattcagctcaatatttcttgctgcagagtatcaatgtggagcatatcttccttgaacacatttacatttacagttccaagaagtcattgggttaaggaagtccaaataaagggtgtgacaggaataatcaatcctctgagttttttcaaaactttaatcatggttgggattttggttttctcaaaggcagcccttgacaaaaaaccatcaaaaatgacagattagggatccctctgttgtaattttccatcgttgctgccaataatgggcaagtctgtctactgaccctcaggaagcctatcaacctatgtgagtgtagattcctgaaaatatgttgttttatcaaaacacatccgagagcttttcacctgctccatccagaccacctaaatagacattgcacattccaccatattctctttcttctggcaaatccttcacctttatgtgcacctgagccttactcattctttacagtagtgttcaagctccatgtccttctctgctattcctggccaagatcttttgatctctagacaactgctgtccaacagaaataaaatgtgaactgcacatgtcattgtgaaaattctagtaaccacattataaaagtaacaagaaacaggtaaaaataattttaaagacatatttaacataatcgaatatagccacattattattgtttcaacatgtaatcaatagaagaattagtaatgagatatgagatatttacttttttcagcatcagctttctgaaaaccagagtgtgtgttaatacaacacatttcaattcagactagacacatttcaagggctgagtagccatgtgtattggatagcgcaacactggaccgcatgttctgaggaggacagggtagttcctggcacacaagtggactcaaatacttgttgctttcagctcttactcctacttacatttatctctgttctgtcagtttgaaatgatcaccatgcccggtgttagttaccctccaaggcacgcacacatctcctcaactaatttacaagcccttggacagagacgaaggagtgtgctttaattttccgcagagtacactgagatgcttgtagtccctaaacctggagttccattgcaggcctcctcatcttggtgcatgttgttacctgtgcctggaatgttctttccccttctcttttgaaaagtaacacctgttttcaaaaagcaccctgtcccctaccacctctcaatttgatttaatgcccattttctgaatatcttttatcaaaatttatgttatatactcacaattgctccttggtttcattcactgccccatgagctgttttgtgtgtgcacgtgtgtgtatgtgttatgtgtatattccatgtctaactggttttagatcactaataccaaatactgtccctataaaatgaatgcaggaatgctacatagcatatgctaaacaaaacgtcagttgatctttataactgtgaaagaaaataggtttctgagctaagatacgctctgcatttatcacctgcaaaataggtaaatggctaactgcccaacatactggctcatttcctggaataggaaagggaaagacagaactttaattctcctgacaccctgcaagtgaggggctgctacccacattttacagattaggaaaaagaggctcagagaggtcaggagacttgctcaaggctgcacagctagtgagtgccatgagaggaataagagtccatgtctgtgtgtccctgaagctgatctttgtgctgaggtcccagttcccacaaagttctagagcagaagccttccgatcgcttcaaataaaccctagctcaggggtagtctctatacagatcatgggagagagcacaatgcatagccacaggtcttttctgttgcagtccccccaccagcagagcctgcccccttccgcaatctgtcaactgtgaacggtagtgacagaagatgcctcctgacttgtcaacagaataggctcctggggacctgggaatggatcagaacagcagtaaaggccctgggtccacgtcctgcagggggtcaggctgtcagagagcaggggtcaactccagcttttgagtgtgagaaactgctttactgtgccctcctgtttctgcaatgatgctttctccctcattaagtgcgtctgccactctctgtaatggagtctgcccaaacattgcctaatagcactgattaaactaagcatgcatatgcctggcaccatggttgctgctatcacaggaatcccagggctgctgagaccaactgcaagacactgaagctgctagtaacaagcctgatggcagcagggcaccagggtgcagatctgaatttgcaaagaggaattgatttcccttccaatatcctgtctctccttctaataagcaggtggatggacgaaagcaaaagagatggcaaagctgctcttagctgcacctgccatcctgagcactgtggtgcctcgccttgaaatggtcatgaccgtgtagggaacatggatgggtttcctcaatcagtttctctgccagcttagtctgaagtcacatcacgcatagattaacacccttggataaacctaaaatctgagtttggattttggtttgttttgtgatagtctgtatatcctgctataaagacactcagcatgtaggagtcagaatcaaaacataaattaggaagattatttttctttgtttcacaacggctttgatgcagggtttctttaaatggtaagtttcattggtgcatttagaatagaagttagcttacaaataaatttttaaagaaaaaagtctggctgtaaagcagctgccatttacagcatggtatctgtgaggcaggcgctgtgaggaacacatgacacacatgaagtctgatgttcacagtaaccctgaaaattggatattagcattcctgttgtataaatgagaaatccaaggtttgaaagtgcaaagttatcaggcaaatctggtgaagcaggttgaattgtgtctccccaaaagatatgttgaagtcctaatccacagtacctgtgaatatgaccttatttggcacagagtctttgaagatgtaatgaagttgagatgaggtcatactggatctgggtgggcctaaatccaatgactggtgtccttataaggagagtgagaagagagatttgacacagaggacagacacacagagatgaaggccatatgatgatagaggcagagactgggggtgatacagctgcaagccaaggaatgccacggattgccagcaactcccagaagctaggaagaggcaaggaagggtccctagagccttcagagtgagcatggctctgccaataccttgatgtcagacttctagcctacaggactatgacagaataaatttctgtggttctaaactgcccgtttgtggtagtttgtttcggcagccctagaaaacaaatacgccttgtaacaccaggtttgctgattctaaggatacctcctcttcctcatagaatttcaaggctgcctgctgtgtggctgttgatactgcaggccctcactcttaccagtaagatccgcctgctcttgaggaaagccggtgagaagcagtagacaggggaatgacaccatctatctgaggtgagttttgcaaggcatggccctggataaaggggaatgcatgggagattgtttagaagtgttgttattgtccaaggaaaaagtaggcggtttacgctcactggtggcagtggagatgagaagaaactgatgactttgagaggtgctgagaaggcagaactgaagactgctagcacttcagatgtgggggcgagggtgaggggctggcagctgggatgctcaggtttctggcctgggtaactgggtgggtgtttatgccatcgtgagaaaggaagtttatcatgattgatctaaacctaatagacttcaattgaaatgcattggtggtagaattctctatggaaacaggctttagaatcaggcaaaagtagatatgtattgcctgtaatgcaacacactagctaagagacgtcgggtgaatcatttaaccccacaggtttcagtttccttatttgttgttgttgtttgagacagggtttcgctctgtcacccaggctggagtacagtggcatgatcatggctcactgcagcctgacctcctgagctcaagtgatctgcccacctcagccctcaagtagctggtacgcgccaccatgcctggttaatttgtgtgtgtgtgtatgtgtatgtacatagtgcattcacatatatatatatgtagacacagggtttttccatgttgcccagactccatgtggtcctgaactccttggctgaagcacctcacccacctcggccttccaaagtgctgggattacaggggtatgccactgcacccggcccgtgttctcattcattaaaagtgaaggtaatgatatgagttagtatatgtaaagagcatatggtatgcaaataatcagaggttagcttttataaaatattttataagtaatatgatgctctcctttggagcatttcaatgatacatcttactcatttttattattggccaggcacagtggctcacatctgtaatcccagcactttgagaggccaaggcaagaggatcgcttgagcccaggagttgagatcagcgtgggcaacatggggagacctcatctccacaaaaaaatacaaaaattagccaggcatggtggcatgcacttgtagtcccagctactcaagaggctgaggtggaaggatcacctgagcctgggaggttgaggctgcagtgagttgtgattgcaccactgcactccagcctgggaaacaaagtgagacactgttttaaaaaaatcattattttaaaataaagtagagaggatcttgtttttatttcctcaattgaatgtgggagaagtgtagggaaactgtggaatatagacactaaggatcggtgcaagctccctttaatatctcaagaaaataaaaataattttctagttctgtctgtttgtgcaactataaggtatttttagtgcagagtttagaaagcccagcagtgtagagagtatatatttctttatttccaataactcatgggaacagcatgtactggtaacaaaatagcactttctcttgactagcagcttttttttcccctgtctaaagggctactaaaaccattatgtttttttcaatgcaggacatcttgtcctttccctgaggttatagtacttggtgcctttcatgatttcagatggtaaactgcttcctaagtgggactctgttctttgtctaagacattttatcttttctaaagcacagtgttcccaccatgacaagtgctatttatgtgtacattatcagagctacacaaacaataattcttacttttcttgaaatatttaaaacaaaacactcagtacaaattaataaagatcaggtacttttaatatttgtataactgggatctgttctttcagctaagatactcataaatctagatgccattattaaaaagaagtaactcgattttctggacatttaaaaacacaacctcaatgatttatcacataaaaagagaaaataaaaccttgagttaaggatcataacgaaagaaagaagttgctaaaatcatgacagagagcttgccaaagccatgccttctgcaacctggttatttccccttgtattttcttcaggtgtctcaaaataaaaagtattcgaaactgaatgcactgtgatttatcctttctaccttcccacccaggtccatcctttctcccacatttcctatcttggttaatgattccattgcccaaccagaggcctgatattgtcccgaacactttcattcttattgcccaggtctgactggtcattgcatcctggtagttctacctcccaattactgcttcagctccttccttctttccacccctatgtttgctccctggaccaagtgttcttgaacttccatcatagccccttagaggtcttctagcctctagtcttggagctctcccattcattctctacttcagtccatgggagctttctaaattgccccattcttccccagtgaagcactggccccaagacctatagactggagggtcagctccctggaatggcatgagaagcccatcagaatgatctcttcctcctgtgaagccttatatttaagtactccttgccccagcctgcacttggtattccagctgttccatgctgtctgcagcctatcaacaataccgtgctgctcctctctgcctggaaatgtttttctctgtcttgtcaccctataaaattattcttaaacccgctgctagttctgatagttcttcctctagcaagacttctgggacttttccttctcatccactgccatctcagcagcccttttgtatcttgaccttctttctattcctgtacatttcttactgtatttttaatgttttaattcccacatctatctccttggccacattggaagctccttggatgtggaggctctttctaagtcattgttgcctcctcaggccctagtgtggacacaccagatacccaacaacttttgaagtaaattatgatctcagttgttcattgccaacagtctgttactccttatcttccactactctacatcccccaatatattttattttgcgatcccaccaggctcttcttatctttgtcttatagatgagaacactgaggctcagagcatggaagtcattcccaatatcacactgctagtaagcaacagagtcaggattcaaccccagagctgggtgaaattgcacagcccagatgctccagtgctcctccctgctgccttcacagaatataagcagtagattgggaccaatttcctcaaatcgcaaaacatttccgtacctgcatgcctatgctcaatctttgttctcctctacctgtagaattcctacttcccctttaagttctagttcaaatgctgttgactgtttgaaatacacatttttcttttttgagacagggtctccctctgcagtggcgccatccatcattgctcactgcagccctcaaattcccaggctcaaagtatccgcctgcctccgacattttctgtttctgtcagcttgaaataatagtttcctctcctgtgcatcctacgatatcttcacacacagatacacaaccctgaaccttctctttcatggcctccaccatattctagctcatatgatagttattcctgcaagaatttcttctttgttaaactgaagtgcctttggtgcagagatcaggtctttttcatttttctgtgaccatagcccctaatatagtgttatgtatataaaagtacatagtactattcagtacatagtactgaatgaataagtgaatgagtgctatatttcatcagcctgtctctgttggagaacagaaggttttataaatattcttgctccctcggcacttggcctggtaatttgaagataagatctgatcaggtatttggctaaattgtatttatatcttatacggtatagttattcttcatagcttgaaagaagaagagaataagagggaaaagcatatgtaatttgggtcttcaggtctgagtccttgaactccaaaaccaggagaagaaaaagagaaagagaggctcacccttgctctggagactgttctcaaccaggagtggaacacagctcccttgtggtgcaggaggaaatgtgtgagtgggttgggtggggagtggtggtgggttatggggagaagtgctggcattcacataagtggtcagaacccagcaatactaacggccctaaaatgcactgggtagtctcacaaaacacagaaccgtgctgtccaaaatgtcaacaatgcagatattagctttttaaaattgctaccacaataaataaccacaaacttagagacttaaactacacaaacttattactttaaactcctgtaggtcagaatcttacatggatctcactgagctaaaagcaaagtctctgcagggctgatacttgccttcaggctctgggggaaaatccatttccttgcctttcccagcttctaggggttacccacatttcttggcctgtggcctctgtcctctatcttcaaaaccagcaacagcaagttgagacctttttccacagaatcactccactctcctcttctgccttaaggacccttgtgatgattagacccatctggataatacagggtgctctgcccatctcaaggtcagctgattagcaaccttaattttatctgcaatcttaattccctttgctatgtaacataaaatattcacaggttccaatgatgaggatgtggacatctttcggggccatcattctgtctaccacagtgcccccacattggagaacatcccacaattattggtccttggtgattatcttctgtgttagatgggtctgcctcaagacaggcattcagagaatagcctgcatttagagagctctgaaatatataccccagtaaaatcctcagcactctgtgaaatatcattccgtctcacaagtccacagcctccacaccccttcccatctcttgtggcaccaatggaagccatcaggaacatcagatctcagtcttgagaccccttttcaattgtagctgtaggtggtaagtacaagtaagaatgaaggtcatggggagacatgttatctcatctagcctgggttattccttattaagttttttgacatcctagttcccagtgctgatattgacaaaagcttccaaatataactatagaacaaaatatttaaagctatttattattaatgtaatcttacaaaaatcaactctacaaaaaccacatagtctatcaacctgggaagtgaaaagaactcataatttcctatgcatgattttgctcctcaaataataataactatgatggctaccattacaaagtgccagggactttatgccctattttatttattccttatgacaatcctatttcattgctattattattcccattttacagatgggggaatttagatacagagagattacattatttgtccaagagcatatagcaaataaatgtagtcagaatttgatcctagctctaccagcctctagaacattcccaggcccataaatataggttaggatgaagaggcagacatggcccaaactcttgtatgtctcagggtaaggataattgttccatgtgtcccataagttgctgtcactgcctaggttaccaggtggtagaggaaggcctgctttatctgtgctcgatgaaccttatggctttctaaggaacatttctgatatccctgataacaactgttaatccagccaccagtgccaagacctcaaactaattagcctaaaaagtcagattagaatggggttaattctgtgatcatttactatttacaaggaggtttgataataaagagaaacttagatctttgtttcaaagagctttcctaaacagcagcatttactgtttggaaaaccaaacatcacatgtgaagaatgatggtggtatttggatggaaatcgcgttgaatttgtagattgcttttggcagcatggtcattttcacaatattgattctactcatccatgagcatgggacatgtttatttgtttgtgtcatctatgatttctttcagcagtgtttcatagttttccttgtagaagtcttttacctccttggttaggtatattcctcagtattttattattattattttttgcagctattgcaaaaggggttgagttcttgatttgattctcagcttggtcactgttggtgtatagcagaactactcatttgtgttctttaattttgtgtcctgagactctgctgaattcatttatcaggtctaggagcttgttggaggagtcttgagggttctctaggtatatgatcatatcattggcaaacagcaacagtttgacttcctctttaccaatttggatgccctttatttctttctcttatctgattgctctggctaggtctcccagcaccatgttgaatagaagtagttagagtgggcatccttgtcttgttctgattcttagcaggaatgctttcaacttttcctctttcagtattaggttggctgtgggtttgtcatagatggcttttattatcttaagatacgtcccttctatgccgattttgctgaggcttttaatcataaatagatgctggattttgtcaaatgcttttcctgcatctattgagacgaacatatgatttttgtttttaactctgttatgtggtgtgtcacatttattgacttgcagatgttaaaccatccctgcatccctggtatgaaacccaattgattatggtggatttttttttgatatgcttttgggtttggttagctagtattttgttaaggatttttgcatctatattcatcagggatattggtctgtaattttcttttttttgttacgtcctttcctggctttggtattagggtgataccggcttcacagaatgatttaggaagaattccctctttctctatcttgtggaatagtgtcaataggattggtaccagttctttgaatgtctgatagaattcagctgtgaatcctggactttttttattggcaatttcaaaattaccatttcattctcactgtttgttattggtctggttcagagtttatatttcttcctggtttaatctaggagggttgtatatttccaggaatttatccatctcctctaggttttctagtttatgcatgtagaggtattcctagtagccttgaataatcttttgtctttctgtggtatccgttgtaatagctcctgttttgtttctaattgagcttatttgggtcttctctcttctttgttaatcttgctaatggtctatcaattttatttatcttttcaaataatcaggttttagtttcatttatcttttgtattttctttgtttcaattttatttagttctgctctgatttctgttatttcttttcttgtgcggggtctgggtttggcttgctcttgtttctctagttcctttaggtgtgaacttacattgtctatttgtgctttcagactttttgatgtaggcatttaaggctgtgaattttccttttagcactgtctttgctgtatcccagaggttttgataggttgtgtcactattatcattcagttcaaagaattttttaatatccatcttgatttcattgttgacccaatgatcattcaggagcaagttatttaatttccatgtatttgcatggttttgagggcttcttttggagttgatttccaattttattccactgttgtctgagacagtacttgataaaacttcagttttcttaaatttattgagacttgttttatggcctatcatatggtctatcttggagaatgttccatgtgctggtcaacagaatgtatattctgcagttgttgggtagaatgttccgtaaatatctgttaagtgcatttgttccagggtatagtttaaatccattgtttctttgttgaccttttgccttgaagacctgtctagttctgtcagaggagtattgaagtcctccaatattaattgtgttgccatgtatctcatttcttaggtctagtagtaacagttttataaatttgggaacttcagtgttaggtgcatatatatttagaattgtgatattttcctgttggacaagtccttttatcattatataatgtccctctttgttctttttcactgctattgctttaaagtttgttttgtcttatgtaagaatagctactcctgtttgcttttggtgtccatttgcatggaatatcttccaccactttaagtttatggtgagttcttgtgtgtgtatgtgtgtgtgcgtgtgtgtgtgtgtgtgtgtttgagacacagtcttgctctgtccttcaggctggagtgcagtggcacgatatcagttcactgcaacctctgcctcccaggttcaagtgattctcctgcctcaccctccagaatagctgggattacaggtgtgcaccaccatgcccagctaattttttgtgtttttagtacagatgcagtttcgctatgttggtcagtctggtctcgaacttctgacctcaagtgatccacctgctttggcctcccaaaatgctgggattacaggtatgagccactgcgcccagacgtgagttcttatgtgttaggtgagtttcctgaaaacagcagatacttggttggggaattcttatccattctgccattctgtatcttttaagtggagtatttaggccatttacactcaatgctagtattgagatgtgaggtactattctattcatgttatttgatgcctgaatatcttgttgtttatttgtttatttattgtatttttgttttagaggttctgtgagatttatgctttaaggaggttctattttggtgtatttcaaggatttgtttcaagatttagagcttcttttagcagttcttatagtgctggcttggtagtggtgagctctctcagcatttgtctgaaaaaagactgcatctttccttcacttatgaagcttagtttctctagatacaaaattcttggctgataattgttctaagaaggctgaagatagggccctgatctattctagattgtagggtttctgctgagaaatctgttgttaatctgataggttttcttttataggttacctggtgctttcacctcacagctcttaagattctttcttaagttttgactttagataacttgatgacaatgtgcctaggtgatctttttgtgataaaatttcccaggtgttctttgagcttcttgtatttagatgtctaaatctctagcaaggccggggaagttttccttgattatcccctcaaatatgttttccaaacttttagatttctcttctccttcaggaacaccaattattcctaggtttggttaacataatcccaaacttcttggaggctttgttcatttttttaaaaaattcttttttctttgtctttgttgaattggcttaatttgaaaaccttgtctttgagttctgaagttcttagtttgttcgactctactgctgagactttccagtgcattttgcatttctctaagtgtgtccttcctttccagaagttatgatttttaatgctatctatttcactgaagatttttcccttcctatcttgtatctttttcaaaatttcattgagttggacttcatctttctctgctgcctctttgattaacttaatgattgaccttctgaattctttttctggcaatttagggatttcttcttggtttgcatccactgctggtgagctagtgtgatcttttgggagtgttaaagaaccttgttttgtcatattaccaggattgtttttctggttccttctatttgagtacactatgtcagagggaagatctggggctcaagggctgctcttcagattcttttgtcccacagggtgctcccttgaggtagtgctctctcccttcccctagggatgggacttcctgagagctgaactgcagtgattattatttctcttctggatctagccacccagtggagctactgggctctgggctggtactgggggtgtctgcaaagagtcctgtgatgtgaactgtcttcaggtctcagctttagataccagcacctgctccagtggaggtggcaggggagtgaaatggactctgtgagggtccttagttgtagttttgtttattgcactagttttgtattggttggcctcctgccaggaggtggcaatttcaagacagtgtcagctgccatagtatagggaggatcaggtggtgggcagggccctagagctgccaagagattgtgtcctttgtcttcagctaccagggcaggcagagaaagaccatcaggtgtaagcatggttaggtgtgtctgagctcagactcttttcgggtgcggcttgctgtgctgttgcagaggatgagggtatggatctcaggctaatggagttattttcccagaaggattatggctgcctctgctgtgtcatgaaggtcgccagggaagtgggggaaagccggcagttacaggcctcacccagctcctacacaatccccaaaatcagtctcgctcctaccgtgcccccacaaaagcaccaagtttattttcagccagccggtgagcagggctggaaacctaccccaggctgagaaagcaaacagggttttcaggttttgtgcctccccgcctgctgtggcttcgtgctgtgtctgcactccctattcaccccctcccctgacttctgtccaggaaacttcatgtttggtcaaaattgttacaaagttcagctggaagtttccttcttcctgtggtcttttccagttcctctggcagcactccccaagagtactttactttgtcttactctctgagacaaactaagaaatggcttccctggggaccaagagcccatagggctcttcccactgctacttctacccctgtattttgctcagctctctaaaattttctcagctccaagtaaggtcaaatacttctcttgtgatctggaccttcaggttccccagtgatggtgtgtgttcaggggtggatgatccccctttcacactttcacacttcaggcactcacagttttttggctgtctaccggggcctgcaggagcaatctgcttccttcaaagggtctgtagattctcttggctttcctggtatgttcctgcagtagttcttggagcacaagttcacaatgtgagtctccacaagctgctctgtccatctgagtgggaggtgcaatttagtcctgcctattatctgccattttcctccccatgccgttgccagaatcttaacagatagacctggaaatctgaagagctgggctctgtcctggcactgcggcagctgactgtgtgcctttgtttccttgtttatctatatcttctattttttttcccacaatggaggcactttttttccacatgtgtatcttatatggtaggagaagttcttaaaaagagtttttcattaaaaattaggtaagtaagataaagactaggggaagcaaataaataaataaacccttgattagtggagatgtttactatctggcaatcccattccagttaaaatgtcacataaaaaacggatacaattttgtccactattgagttgcatattaggaaggatagatttggctttggaaagaaactattttattatttaatagttaatttcttaacctaagagaattctttattaacatttttaacaataaaaaagtttttcttcaaagagataccatctcacaccagtcagaatggctattaataaaaagttaaaaaataacagacactagtgaggttatggggaaaaatgaacacttaagcactgttggtgggagtgtaaattagttcacccactgtagaaaatactgtggtgattcctcaaagacctaaagacagaaacatcattcaatctagcaatcccattactgggtatatacccaaagcaatataaatcttctattctaaagacacatgcacatgtatgttcactgcagcactattcacaatagcaaagacatggaatcaacctaaatacccacctatggtagactggataaagaaaatgtagtacgtatacacaatggaatactctgcagtcgtaaaaaagaatgagatcttgtcctttgcagggacatggatggagctagaggccattagcctcagcaaactaacacagggacagaaaaccaaataccacatgttctcacttacaagtaggaaactaaatgatgagaacacatggacacagggaggggaacaacacacagtggggtctatcagacggtggagggcagaaggaggtagagtattaggaaaaataactaataggtaccaggtttaatacctgggtgatgaaataatctgcacaacaaacccccatgacacaaggtttcctgtataacaaacgtgcatgtgtacccctgaccttaaagttaaaaagtttttcattagaaaattcaaattaaactgaataaaaccttcaattctcatgaattttggcaatttaaaatcaaataaacattctgcatcatattttaaaaactatacaaatacatttacatatctaaatattgtatacaatatacaaagtggtatacattacacataacacacattctatattatgtgatatctattatatattatagatttgtatatagtataaatattctatataaacatatacatttattatatactatattaatataagcaaatacatatacaaacatatataagcaaacataagcatataaaatataaacacacacacacaagcacacaaaacaatgaccaatgacagagccaggttccaggcatcagacgccatggaaggaacagagggcttcaaccagacaatcctggtcttaaatcttatctctgtcgcagtagcttcgcagatctagcttaagcagatgactcaacccctttgagtctctttcctcatcccatcactcaggctaataactgactcccaggactgttatgaagattaaatgagaagatgtgggtggcaagcctagcgcagagcaggtgcttaataacggaagccctccatggctgctttcctttgttattctgactctaaattctgtgttctttccactacaccacccaacaatctagtttgtgtagcacacagaaccttctcctacatctatatctggtaagaagctttgcacctcattctgcagctgcctaacctgcaggaagttgcatctcactggcatgcatctgtagacttcaagactttaaaacctccttaccaacctgggcaaacccatgaaatgattaaaacaaccaaataaagcactagccttttgatttctctttaacttagtggtctagtgtaaccctttatttttctatttaaaaaacattgcaggttctatttcttgtcttcgtttcttgaattttactgttcatccaaagaaaatcagaagcatttaccatagcatgttgagaagacatctgaagatctccctataattaataaatacagagcctttgccttttcaactaacagaaattaggtgaatctgctaaatagttcatacatgctggcatttttagttatgttaagatttcactcaaagctcctctacaaaatgtctggaatgaagagactgcctatctgagagacaataatgggtttcttctaaataccttctcattgttcacagaattgataacatgctaggtgggataaaaaaatcaattgtgtaaaatgtggagttgtgaataggaggttaatgaaaaataatatatttcagtcagtctgtgctgtcacaaaagacacgcaagtgaagaaagtaaaacttatacaactgactgaatgctgagctgatggagttgcaaatgatgaccagatgttcaggttctaatcctgccctgataccctcaagatgagaacatcgacttttccattgagaaaagggacctggcaggggattgaggcagtcacccaccctgttatccgagtttgcattattataggccagcttgtggcaggtttttacaagttacagtttacagaatacttacctatacataccaaagggcaatagtgtctttaggtttattacattatcaatattggttatctctaaggatgcataaaggtttatttctattacttccttgctcttctgcaccttagtttcctacctataaaatagggataaaacacaccttccttagaggttgttggaggcctgaatgagatatttgccatgtgtcttacacagtactggggaggctggacaatcataataaatcatgatggttaagtttctgtgtcaacttgattgggctaagggatgcccagatagctggtaaaacatttctgggtgtgtctgtgaaggggtttttggaagggattagcatttgactcagtagactgagtaaagatcacccccaccaatgtcggggggcattgtgcaatctattgagggcccaaatggaataaaaaggtagaggaagcacaaatttgctctttctgcttaaactgagacatttgtcttctcctgccattggtcattgatgctcctggttcttgggccttcagatctggaatgaatcacaccactggctttcttcgttctccatcttgcagatggcaaaactgggatctctcagcttccacaatcacaatagctaattcccacaacaaatctcctcacatatactgtgtgtgtgtgtgtgtgtgtgtgtgtgtgtgtgtgtgtgtgtgtctgtgtctatgtgtgtatgtattctattggttctgtttctctggagaaccctaaccacataaatggttgccattcttattaccacagaaaggaaccttaactggtcattgcaaatgcatctaacataaagtaattagctattatgggctcttccaactaaacatgaatttggcagcacatactaagtacttactgtgtgccagacaatattattccagcactggggctacaaagaattcacagtctacagggaaagacaatacagaactctattaacactgagaagtactgaaagtaggccgaggtccctgtgtgtagtggaaccaataggagaagcatccaaccctaacagaagaggtgtcccttcagctgagttctgaaggatgatagcagtggaggagaactgggcacttcaggtagaactcacagtctacgcaaaggcatggatgcagaaagtatcagggcacacagagagaagagtgtggctcagatgaccacagccaggcaaacccactgcccaaaggctgaggtcagggatgaaaatgaaggaagcagaccacagggaggtttgggtctgccacagctccttctctactgttgacaaggttcagctgaaaatccgagtttctttgtacaactttcgctcattaaaatggctgttaacaataatgctttaacgccactttcttaaacattatgagaaatgcagatagttctataacatatatatatatatattcatagctaactttatgaaagtatatatttcattttggggtcccttacctctacagtctttcccatgactcagatttacttattttaaggcaaagattcatggcttccaaacatttgaaaactcaatttcacaatgttgagaagttcacaactagtgacagttatttctttctaatcaagaaatgatcagacatttatgctgactttaaactcaaaatatataccagagttgtgtgtgtgtgtgtgtgtgtgtgtgtgtgtgtgtcacaatgcactcagaatctgaccacttctggaggcctctactattaccacctgcccgataagtgcaatagcctctggcttattggtctccctgccctgtctgccttcatcccagcttgttctcaacacagcagccagagtgaccctgcacaaaatgttgtcagaatatatttctcctccactgaaagccttccaaatggccccctatctcagagcagaagtcaatgcccttatagagagactccagatctacaactacctgcttccaatcttacctctctgacctcacctgccttgcttatgtctctccagctggagagaaaggtatccattattctctctgcaatgctgtttacactagctatccacatagatctctgttatctccctcccttccttcaagtctttgctcaaatatcacctttctcaggaaggctttctccggtccaccttatttaaaattgcaacctctctgcaccgcagaactccctatctcttttctctccttcatgcttttccatagcccttctcatctactaacatcctatctcatttacttattttgtttatactatggctccctcttccagaatgtaatctccacaagggcagggaacattgtctcttttgttccctgctgtaatccctagcctaacccagttgaggtgtgggggcagtgcagaaagcaaaccacccacggtcctgtggaggaactgggtctccctgggatttccatgtctccatcttctttgcccctggttcatactgctcagctaaaaaaggttttggaggaaaaacattctttatgcagcacaatccataaaaataaagcagtgggcaataatagagcccactagtagaacattagcaggcttggctgtcatctttgttcttagttaacatgagcatttcagagacatattgaggatctatagattagtgagtggcaaaatcatttgctttcattctctagagactcattcaattaacctttatctaagaagcagtatattatgttcgcagaatatttgagagaggtgtaacaaacactagtttgcagaaacaactccttcatgtaacagaaataggaactgattgatgggttctgccagggtgattgatcgtcctttcttctgtccaaatttgctagcttgattttacgttgacatttcttatgcagttctctctgccatgggttaatgggaactgggacctagagagcctctgaaactcattatcttgcatcatggatgtgctttatgtgaacattttttccagagctaagattctaactataacaatgctcacctgcagtgatgaacatccacaaatgttccctgggccaggagtaagagtctcaatgtctaaggcagcacacgtgaaatgacattgaatgtttgttttggtgctgatagtagacggttgcatacagaagtacaataactgagaatacaacctgggcccttctgtaagcccaaccgggagaaacattaccttaaattaaattgctaatggatagtagcaggaataaagatgccagcaatagcaaccctcaccttcagagctcttttccccttctgtaaattttaactaaaatagtaaaggggaaaaacttcaacaccaaaccacagaagtggaacatctcaatctctgtggccatggtatgcagaaaaccctgaggaaaggcctgtttccatggcaaagtataaccactacattatatagtgtgacacagcaataatacagggagcaggagaaacacagcgttaagtagaggtgacctctaaatacacaaacgtactgtaagaaatatccataggaaatatcatggcatctttaatttgggattaaacagatgtatttagttgatattaaaatacattcatcatgaaaactaatttgtctttattctaagcaagttatggaagaggtggaaaatttttgaaggtagggccaaagggaaaccccagaaaagtcatgacttacatccattttccattctttttacttcatgtattgattagctgtactgtctcagagtgagatggattaaaaaacaaaacaaaactgaaagcagctgtttcaaaaaaggtttagagtaaaaaatacacattatgagtgcagtaaagctagggacccaccgtgaaaaatcagctacacaaatttcattcctagcataatgctgatgcaaaatttcagtgcagggcatttgccaaagggagaggagggaaaggtttactatgaaatcctttgaaaggacagtacattaactattgaacacttactgtatgctagacgctgtaagtgcggcgaggtaaaactctgaaagcaaatcccccacaggcaagatgcagtttagtgggacagaaggatgaacctgaacaattataaaactgatagcaggaaacacaggtctttgctcctagagtgctactgaagcaaagggaaaggaactattgcctcagcataggtttctgggagattacatggatgttgagcggtatcttgaaagatggaggagctcattgtctttatggaaatggaagagtccagaaaaggtgatgggcatttggtctgaccacacctagccattgtgatcaggtgatcttcatttcacattcagtgtcctgcctggaaattgtgctctgaacttttttttttttttcagtttccaagaaacataaatttattttttcatgaaatgtgtgttcaaccaaacctcactaacacaacaatatttagttcattttcccacttattttaaatggaggctttcaaccagagcttctgaattagcaaggaccgctataccacgtgatgaaaatctagctaagcataagcagaactgaaattttatatagctagaacagctttcttgtgctgagatgggagcatttaaaaacattatttttttgaggcggggaggaaacacttaaaaaagctgttggtgatttcatggttaccggtcctgggcccaggggctccacacctctttttgtttctcttacttcctggcagttcctccctgtgtctggcttttcaccatctcccctcctggggagtagcccttggaatactatggttacaagcaaaagaaacttcctgcttaatttggaaagggcaatttattgtaaggaatggggaactcactggattgaaagaaaatcaagaattgggtttaaaaacagtagacacagggtgctctaggggaccaggcagcaggaactgatgggcaatcttttcaggatgcccctgcagggccaataagctccaacttttttttactgttttgtgacatttcattcaaatttctgaggcctgggaaagagacagacagtcctccttggacgatgtggtttgttctaaaagaggcaagaatcccttcccccattggaaatcaggctgctgcactgaaggacatcctctttcctcttcaaggaagttcttcttctagaactagggtaacatccttaaagcaaacttccattcaggactcttgatgatgctctttttgatcaacatgatcaaaactagtttccgtgatgatcaaagagagatggagtgcttttcctgaagcattcaggacatgtggctggggagagcagtaccttaaagacccacactacaagtgagcataacagcaccaaataactaaggaaggggaaaccccagtctatctgacaggcaaaggtgacccttgaacattttaagggtttcagggtagtgagtttcatctagacttgttgatatctggaatttgggtctttcattacgaaagacaaattgtgaagaaagtaggtatataagaaacctggaaaacgcaacccagatgacaagatggcagcattgcagaggtgagttcatatctggttcttggttgggttaacaaattcactatgttttgaggagaaggatgcctactcttaccactcctgttcaacatggtactaatattcctagccagagcaagcaggcaagagaaagaaataaaaggcatccaaataggaagacaggaactcaaactatctttgtttgcagatgatataattctacacctggaaaacaacaccctctctccaaaagttcctatatctgataaataactccagcaaagtttcaggataaaaattaatgtacaaaaatcactagcatttctgtataagtactgcatgctaactgactgcgccactggagcatgctaaaaatcaccagcatttctaaacaccaacaatgtctaagctgagagccaaatcaacaacacaatcccattcataatagccacaaagagaagaaaatacctaggaacacagctaaccagagaggtgaaagatctctacaatgagaattacaaaacattgctcaaagaaatcatagatgacacaaacaaatggaaaaacattccatgctcattgattggaagaatcaatattgttgaaatggccatactgcccaaagcaatttacagatttaatgctattcttatcaaattaccaatgacattcttcacagaattagaaaaagctatcttaaaaattatatggaaccaaaaaggagctcaaatagccaaggcaatcctaagtaaaaagaacaaagctggaggcatcatgttatctaacttcaaactatactacaaggctacagtaaccaacacagaatggtactgatacaaaaacacatagatctatggacacatagacctatggaacacaatagagaacccagaaataaagccacccccaaaccatctgatattcaacaaagtcaacaaaaaacaagcaatgggggaaaagactccctattcaaaaaatggtgcttggataactggttagccatatgcagaagactgaaactgggtcccttccttactccatacacaaaaatcaactaaagatgaattaaagacaaatgtaaaaccaaaaactataaaaactctggaagataatctaggaaatactgtctggacattggacttggcaaacatttcatgatgaagatgccaaaaacaaatgcaacaaaaacaaaaatggacaaattggacctaattaaactaaagagtttctgcacagcaaaacacactatcaacagagtaaacagacaacctacataatgggaaaaatattcacaaactaagcattcaacaaaggtataatatccagaatctataaggaacttaaattaacaagcaaaaaacaaccctattaaaaagtgggcaaaggacatgaacagacacttttcaaaagaagacatacacatggccaagaagcatatgaaaaaatgctcaacatcattaatcattagagaaatgcaaatcaaaaccacagtgggataccatctcaagccagtcataatggctattataaaaagtaaaaaataacatgctggtgaggttgcagagtgaagggaatgcttagacactgttggtggaaatgttaattagttcagccactgtggaaagcagtgaagtgatttttcaaagaacttaaaacagaagtaacatttgacccagcaattccaatactggctatatacctaaagtaatataaatcattctaccataaagacacatgtacattgatatggtttgcctatgtccccacccaaatctcatcttgagttgtagtttccataatctccacgtcttgcgggagggagcccatgggaggtaatttaatcatggggcggttaccttcatgctgttctcatgatagtgagttctcacaagatctaatggttttataaggggctttcttccctttgctcagcacttctccttcctgccgtcatgtgaagaaggacatgtttgcttcctcttccaccatgattataagttttccaaggcctccccagccatgctgaactgtgagtcaattaaacctcctttctttataaattacccagccttgggtatgtctttattggcagcatgagcatgaactaatacacatgtgtatgttcattgcaacactattcacaacagcaaagacatggaataaacctaaatgcccttcaacagtaggctggctaaagaaaatgtgatacatgtacaccatggaataccatgcagccataaaaaagaatgagataatgtcctttgcagcaacatagatggagctggagaccataatcctatgtgaacacgggaacagaaaaccaaataccacatgttctcacttataagttcaagctaaacattgagtacacatagacacaaagaagggaacaataaacaccagggcctacttaagggtggagaatgagaggagggtgaggatcaaaaagctacctattgggtactatgcttattacctgggtgacaacataatctgtacaccaaacccatgacacacaatttatgtatctaacaaatctgcacatgttccccgaacctaaaataaaaatcaaaaaacaaaacggaacaagttcactgtgtttggggtatgtaatgtataaaatggcatgttactcaccccttgtgtacatagtcctcaagttacttaaagtttatgagccattatgaaactctgtaggaattcgtgtgatagactcgaaggtgaaatcaattagggagcaaacagacaaattcctttgtccatttgggtggtcccacatatcaggccatagctatgacggaaaatgtttcctgacttcctcacaccgttcacattcctcattctgaaacattgtaccaatgtgttccacgccgtgtttctcaacttcttcttgagcttccaactttgggatcataggaccactttcctgtttggggttttacctttacacttgactttggtacttacttgctctctggctttgacctttgcattcctccttgagtccaaatcagattcctaccagttactactttcagctgtcttgattagcaccccaagtcattaggattggatttgaaccctataatttgggtgacaaatgctccagtcaggtgctgtgacccctcaggatccaggcaatgacaaaggtgcttgcgttacttaaatgttaattcagacaaggcagttcagtggggagtcatccctttgccccatgtgtgtcttctagtgtttatgcataaacactctgtactttccagtaatttatctctcttcttttaccatttcattaaactgccaggcaatatttttgtatgctttcgaaaagctctgtgaaggctcctctcagtgatgggtgaaatgatttctaaaaataacctgcaaatcaatttgttcagcttgtagcttgtataaatcttgaagtaaggtgctattaaatgtgcaaaataaaatattttagtttagaatatgttactaataccctgcgaaaagagccctggatttagaaaacaggacttgataatcctggctttatggattactgattgtgtggctttaggcacatcatataacttctccagagcctcagtttctttgattgcaaaatgagagaataacatctccctcattgtattgtggcaaagtacaatgagaaaacatgaaaatggtgccgatagaaagctgggtatcatttggtagacttactacacatttgttaatctttgtttgaacacaaaacctaaaagtgattccaagtagtcactggggtatacggaaaagctgtaggaaagtttacttttttaaaagagttgcatagaagaaaaacaaataaacaaacaaagaaaaagaaaaaagctgcatttcagttaagttgattagaaagaaaatttccttagaatgagttttgtttttatcttcattttaaggacgcaaagcagaatgtgttgctggtgaatagctttcatttaggaaatgcactaggagtgcatttgcagaaatttttgaatattattttactgatataagtttcttatgtggccccaacatacatgtctttccctaagccagaggaatgcctcttattttgcatgtccctgcatgtcatgctcagagataccagaatttaaattcttttagtctgttacttgaataaatacagtctcatagtgttaagctcaaattgttattgagtacacaatatatattacctcagtccaaattttacccaaacatgaaactttagattctatgaaacagattaatatacatttatcaaaactctaaatttataatgaaagtccctttgctgagagaaaaaccagcatattaagcattgctttaatccccagctattttcctagttgttttacttttattatttcatcacattttcaatatgacaaatatcatcattgccattttacagataaggtaactgaggctgagtgaagtgaattaagtggcctaagttgtaaatggtacagctttcttggctccttagccagtgcgcttctccacggagaagtgtagtggttacaccaggactcccgaagaaggaaaaaaagagcaaataaatcagccatttattctacaattctgctgttttgagcttttctcaaaaggccatattcttagttaactcaatttagtctcaataagattgatacagctcctatgatttgatattctgactagtaaggggagctgctgaaagcattttggatattaaggaattattgggcacttctttcaacatgtctgactaatgctcagaatattcattttcctacagagtacgggagtgtgatagatgacgtcatgtttattacagtttgcagggaataaatgccacaggcccattgacatgctggggaaagggcttgtcagtgtggcacatctaatataatcttcatcataaacaatggcctccacttctggccatgtccaatgtgtaaggccctcacctggatctgatattttctcctgcccagcacctacctctcctctttttaaaatagcatctcaagtgtcttagaggctctctctgtttgggttaattttaagtgatacataaaattgactgggccaagggatgcccagatagctggttaaacattacttctgcgtgtgtctgtaagggtgtttctgcaagagattagcaatgagttggcaggctgagtaaagcagatagccctctccaatgtgggtatgcatcatccaaactactgagtgcctgaacagaataaaaaggcagaggacagagctggaaccttgatcttttactgccctcagtgctccaattcttaggcttttcgaatttccagacagacaccagcttttctggctctacagcttgtagatgccagatcatgtgatttctcagactccataattgtgtgagcaataacctaatatcttatagtaaatctctctctctctgtagctttatacatgtagctttatacaaacacacacacacgcgcatgcatacacacacacacttctcctattggttctatttctctggagagctctgactaatacaccctttctcctactgtgggtccgtttgatttagtaggggatggatcccaccctcggcttcacgaggatgcatgactcaggctcattcagtaagtaggccccacctctgggctgtagggcttgcagggactggtaagaagctggatacttgactcaaactggtgaaatgctgagactgttggaggaagcactggaaacaggggttgtctttcctctggggatggtaagctgatgagatgtaagctaagatctactggtggctttcttgtttactgtacaaggaacctgcctgagaatagaactaactgacagaaaagcaaagttgaatgcagaagacacacagaaagaggtaaaggccaaatggtactgcctgaggcctccttagatctagccattctgtagctactggacaattcagtttcataaactactgtggcttttctcttttttcctttttgcataaatgaacacaagtgattctgtaggcttttatatattcagtctggttccaaatccttttcccctataattcactagattacacctgatgctgaataatgaatgtgcacagtacacagtggatttcgatagaatggaaaagtggatcagctggagtagtacagccaccactaagggaggcgtattgtgtgtgtgcgtgtgagagagagagagagagacagagagagagacagagagagaatgtgtattggcaaaagaaaaagacagtgtcacattcaaacaacaggttcatatgataattagttaaataatgaaaacctttgaagctgcccaagataatttcaggccccagacgtccagcacaaggtgttccactcaattttagtccactggcaacactgaaacatcctcctttgaaggtgtgaacaagaaaggatgagaagagccctcacaaatataggatgcacctgcatgtaagggaaactttggaagggtctttaactacctcaaccaaaaaaggaagttcaatagacaaaggcctccaaggattgaacaatgcacagtgtagccacatgccagccccctgagactcacactagtggggctcccacaggacagggccaggctgtgaaatctcccatgggcagaaaagagatgtgaagagaagaggctatcagaaaatgaagaaaaggaccatagggaatcaatctttggaaaagcagggctcaaggtgactgaagaccacagtgatggttgtgttcatttgccctcagtcatccatgcactaccatcatggttttgccatagctgggttctatctctgcgattattaacctagtactttaagagtagtttaaaggactcacttttctttcacttcctcgttgcttctaagcaataacttttgagaaatgggtttatttctctggttaaaagtacagaaccagttatatactttcctagtatatgttaaaataagcatataatcattaaaaatgtttgtggtaccacctaaaatcttttcaaatgtcacagtactggattccactcattgggcaacactagtatataggacaaggactggagttcaagtcaagaacaaggatgaggataaaagttgcttcccttgagatgctgatattgtccagggatatcagtttcatcactgctttcctgaaagctctacccctcccctctgctcagggcactccaatgcctttatactacaagggaagattgtttgcaagcaaacactggaattataaaaatgagtaaaatggtcaaatgtggagcttttaacaagaggtaagtatattattgttacctcctgtcttcagaaagggctaaagaatgaccaaggagttcactgcattaacctatctgtaaaagcagtagataccaaatgtcatacttatgtcatagatgaatggcaattatgtatgcataactaaaagtataatttaaaaaattctctcaaggcttatcaggaaaccacattaagcagaacaagtcatgtatctttaaaagccatgaactatgttgtcaagtcacaaaacagttgccacttgaactctgggaacagactttcaaagacagatttctacaggtttttttccactagaattttacagacactaataatgacctcactagattttcttttgattcatgctagaaaaaatagactgtaatttagatattgtttgaagatggactgtaataccatacgacaaaattgaagccaccttattagttttttttggtctttaaatttcatgtttagcttcactgtggataaaatatgccagcagtaaaacatgaaacacggccttctctttgaattgcaaagaaaagatgctttatttattttgtgacttcaggtggagtaatggtttctcatccttccaataatcactctttattcactcagcctgctttatttttcttcctagcacttgtcactatgcatcacattcttatttgctgtgtttattgtctccttcctccaccaaatgtaagctctttgagggcagggactttatattagtcatgtagtctcccagcacctagcaaaatgctcagtacataggaagtgctcgataaaaatttgttagatgaatgaatgttgattaatgaccaaacgtttacaattagcaaattgtctcatttttcaagctttactcatcagcttcagatccaaaaaatacatacttgttagccatttgaccttaggcaagtcacttaaccacataacttctaacaggttgtgtttctgtccataaaatggggacattattgactgatagggcatttgtgagcataaaatgaggtaacatccatgaaagtgttggtttgtctatcttttatttatttacttatttatttttattattattattctttaagttccagggtacatgtgcacaatgtgcaggtttgttacatatgtatacatgtgccatgttggtgtgcatatacccaaaggattataaatcatgctgctataaagacacacgcacatgtatgtttattgtggcactattcacaatagcaaagacttggaaccaacccaaatatccatcaatggtttgtctatctgtgtaaccaggtctctgatcattcatttgtctatatatgaatgcagcctgttggcaaaggatttggtccatggtaggtgcaccatgactgtttactagtttattaatttttaattttaattttgctacaggaagtaatgatttccttttcagttgttgatggccctgtctaaaaccaaggacaagaaatcactagatgaaagcattgcctttatatacctaaactcttactctttatatatcttcaatataaagagatttaaaaacggtgttttttccaatcaagtacatttagaggacaaaaataagaaaaggacatcgacaagactgataagcactaaagtcatcttccctgtccctcctaaaaggtcagtttcattttgtttttaagatgcttctcatgtacagaagacagtgttgggaaaagatgagtttgatttttataaaggtgatttccgaggcactctttatttatttatttattttttaaaaataacttcttccctttcttctttcctttctttttctttctttttacctgtctttgttcattaactagaattaaattaagtttttggttatttcccacaagcaagataaatatctaaaaaacagataggttgggggaggaaaaatggtcaatagaaactttcttagaagatgaaaatgtatgttaaatcctcttcaaattataattttcaaattctcactgctaagacaaaattaattagttcaactaaaacagagttgccaattaaaacatggttaactaggattctctaaaaaaaaaaatcccaaatcttacactgttcattctaaataaacatgcttttaaagattaggaaaataattacctatttgcacaggaaaataataaatgatgaaatctcaacagatagggtaaagatatcataatattatcttagcaattggctcaatcacttcccactcagtttaaacgctttaataaaaggtattttatacaaggaaagtcctaaatcaaggttattacagattacatttatgtaagtatttgttctctcactaatggaagatttcctctctaatattttttctaaataatttgttaaccggagaagaggaaaacaaaatatttttttctaaaattctatcgaggacttataatttattttacttttattctctgataaagaaaaggctacagggaaactagcaggcgaaagactttctaaatgtaaatgctgcccaaagaaaaaaagaactgtgattagattattaggtataatatgcatcaagggttaaaattcatatacggagaaatgcatgtcaattgcacatattttaaaattcactttaggaatttatcataaagagttcagatatgcacaaagataaacttcatggcaatattagttacagaggtaaaagaatacaaatccttgtttcccacagcattcaggcaagtgagactaccctatggagacaggaggctgagcatctgcagaatttaaactaggaggcttggactcagagataccaaacacagccaagggcaagcatggcatacagagtgaaaatggaggaactgtgcaaattgctgtactaggcccctcatcaagttgatttccctgtttttttctttttcctccggcaaagatgggagctggggagaagcaaatgaccccagagagaaggccgttggggatttaaatttggggcaaataaaaaggccggccagccatatatttatcctagagcagcagttctaactggaatggggcgggggtgggcttccccaggggttagagacatttttgatttccataactggaggggcatggtgctactggcatctagtgggtagaggctagggaagctgctaaacatcctataatgcaaagaacaacaaaacagccctcacaacaatgaattatccagccccaaatgtcagtagtgccactgtaaagaaaccctgtaatagagtgaagcccacagttcacacctgtcccatgcctccattactcacacaggacttccaaaggctcttttgggctttggaatatgattggcttgccttttaccagacacttgaggaaagccctcacaatgaaagtcaagacaaaaacccacaaacatcaaccaaacaactgaataagaaaaaaagtattggagaaaacagaaatcattaaaaatcttaagaagaaaaactgtaattgatacaacccaatctgaaatataatttggcaatatctagcaaacttgaagctaaacccacgtgaaacccagcaattctgcttgtagggatttgtctcagagaaattcttgtacatgtcactaggagagatgcacagattattcatagcagcattgcttgttagtagcaaaaaaaaaaaaaaaaaaaaaaaacctagaaaaaatctaatcattcaccaaatgagaatggatagattaattatagactattcatataatttgaatgccaaaatcacttaaaatgaatgacttagagctaagtatctcaatacagatacacttcataaatataatattgacttaaggaaagcaaattacaggggaccacattcattaagatactatacaaagttaacaagctttgaataaatacatgcaacaactttactatatctactttaaggcaggggtccccagtccctgggctgtggaccagtaccagtctgtggcctgttaagaaccaggctgcacagcaggaggtgggcaaagggtgagtgagcattactgcctgagctttgtctcctgtcagatcagtggtggcattagattctcacaggagcaggaaccctattgtgaactgtgcatgtgagggatctaggttgtgtattccttatgagaatctaatgcctgatgatctgaggtggaacagtttcatcgcaaaaccatcctcaccacacccctaagccccaacctcggtctgtggaaaaactgtcttccacgaaactggtccctggtgccaaaaaggttgggaccattgctttaaggattcatactcgtctaccaaatctataaggcaatacattttagctatcctccagactcaacatgggaaaaacagggaaatcaacttgatgaggggcctagtacagccatttgcacagctcctccattttcactctgtacgccatgcttgtccttggctgtgtttggtatccctgagtctgggaggttggcaggaaggaaagtaactgggatgtgtattcagagaactttgagtatgtgatgttttatttcttaagctgcattttgggtctactggtgtttgctatattattctatatcttttgtatgttttaagttacattaaataaaacctatttttaatatcatccgaaagataaaagaaaatattgcatccaggaaaaagcaatgtctcattcatgaagcaggaatttaactccacaaacatagcacttctaagaaaatctaatgtgtagtaaagctattacatgttttaaaatataaaattaaaatgtatgggctttctttaaaacatttgtaatttaatttcaaatatataatttaaatttaaccgtaatggcatcattttagaattgagtttttcttttctaataaccaggtatataaggtaactttgtcatgtacctggtttgaaaatgttataatagatcccaatacatcatatgccatgtcgagctattttcttttaagtgttcttaatactaagcattggggtaaatttttaattgctaaaaagtgtaactgattatatttgaaatatttagcagttatgatccacaataacaattctaggaaattaaaaaaataacatgttagtcaatgttttaattaatatattaagaacctacacaagtgattgcatcaatggctattgaaattgaaataatgacttctgaaattattttaaaaatatctttttctaagaacatatggacacatggtggggaacaacacacactggggcctgccgggggtgcagcgggagggagagcatcaggaagaatagctagtggatgctggacttaatattcaggtgatgggttgatctgtgcagcaaatcaccatggcacatgcttacctacgaaacaaacctgcacattcggcatatgtaccccagaatttaaaataaaagttgaagagaaaaaaatcttttccttggcactattttgttctaaccagagaactaatttaggaattgagaaaagcataaaaagtatctgttctttttaattgcataaataagtgatacaaaaaaagttctgagtgagttctataagtaaatattttaatttccttacactggcttagctaaaattatcattttgtcattttagaaatattgtattattataccaagtagtgaaacatttaaaaatatacatttagcaggttaaaataatcatgttcatcttttaaagaaaaagatcctcaaagaagacacaattcatactttccatttttcattgacatcattaagtactcatttaaattagtttcggaaactgaaataactttacatttttttgatatggtggcaaagttcacctgaaaaaacaatttctaatttaatcattccttcatacatggtatgttccctctaaaagtgacaactctatacttctaatatatgtaaatatatattaagaccatggccaataacaaaacaaaacaaaaatgaacaaaaatgttttaatatggaaacatttttatgaaattaaatttccctggctagttattgaaatttatcttatttaaatgatttaagtttattctagcaagtgcttctaaggtggagatgctaatacaggttgagcatccctaatctgaaaacccaaaatctgaaatgctccaaaatccaaaacgttttgagcacggacatgatgccatagatgaaaaattccacacctgacctcatgtgacagttctcagtcaaattgcagccaaaactttgttttatacaaaaaattaacaaaaatattgtataaaatcaccttcagactatgtgtatatgaaacataaataaacttgatgttgagacttggggtctaatccccaagacctatcattatatatgtatatgtagatatttcaaagtccaaacaaaaaaatctgcaatccaaaacacttctggttccaagcattttggataagggaccgtcaatctgtatagctgtgtctacaaaaataaaatggtaaccaagaagaactctaaaattagatttgtaaaatctccttcagctctaatatttcatttactcatcccttcatctttaatgacttcagtcattcatttgttcgctccttttagagacttcctatgtgccatgcagtgtgcactctggggatataaagagaaacaaaagaaatttgctttagctatagtacatcagtatgaaaggtgggaagggatcacaaatccaaatatcaaatacacacagagttcactctctgtattgcagaaggaaaggaatcctgcctaggtgacatggacccacccatagagaccttttgtatgggaattgtaccactgctctagcactttgctcacaaagtatggcatatcacacttccattcatttatagtggaagacatggaggcacagagaggtgagagaacttgtcgaaagtcacagagcaagttagaaggccaaaatcagaatatatggtctattgtaatattttcaacaaatgtattgaaaacttggcaagtgtctggcttagaaccaggaatggggactacaaagatgaataagatggaattcctgcctagaggtgcttatgttctggtgctggcagttcccagactcgggggttctggcaattactgtaacagctgattatcttggtacctactgctgggtctctgagtactgtgttagcatataaacaaacgtggaactgcatggggacaagaacggctggcaaagtaaacatgggaaaacatattcagtgtggctgtaatctgtaaaatgcaaattcaaagaagaatttgtttctacctatccatcttgcaaaagtcttaaaaacactcaaaatggagaaattgcccctctcatccactgctgttggaaataaaaattttgtgtttagataccaaagttgcagcattatgtacaggcttataaccaggaacaattatgttcaacagtaagtgaataatgtttcactaaattacggttacattcatgcaatattatgatacatgaggcagtttcttaagattacttaatgacctgggaaaatattcatcatccaatgttaattagaaaaccagcatattaaactatatatgacatgcattttctaaaaatacttttctaaaaatacagtatggatgcatatctgtatcataaacactggaaagaaatgtatcaaattaatacttgtgattatttctggggggtggtattacagatgatttttatttttctcctttgtatgttttccaaattttctgcaaggagattccattatttaataatttagaaaaaataaaagtaagtcttaaatttttttttctgactagatgattctctgaaataaactaactgctcctgactggtttcaggacaccaatgactcagccccttctggttaggacacacgggtgcactagagaggtcctgagacctgagctccatgacccagatttgttttgctgcttactggctgtgtctttctgggcaaaagagtcccgagcctctgtaattgtatttgtaaaatgtggcaattgacgtctgcctcacagatgaagtttaaagacagtataagaaaaatgctttgaaaagtactatataaatgcaagctatgtctcacctgagacatagataagacagagaacacactcaaatcccaaatgaccaacttcttggttttatgacatcacttaaatgacagaacctctttgagccttagcctcacaatttgtcaagtagagatattactggcttcttcagaaggtggatgtgaactaaacaccttttgcaggactcagtaaatgttagctttcttcctttcttaggctctgtctttccccactccactcttactctgaaacaaggatttaaaaaaatgctctggcatcagcactttctattctaattttaaagcatattatttactttgtttttttgatatgttaaaaatgtatggattctttttcctttctccacccttttacgatgtggacaaacagcaaacacaaagtaagcagaacttgggaaaatcaatgtgaggactgtggacaaattttatggggtcatttgagcctgaagttttccacagaaagctctgaaactctaagcactttcctttagggcaggcagagtaggaagggtaagaacgtccttgctttggtaggctgaaattatttcagcaattagatctccctagattctggatttatctaaatatacctgtgacattctgtaaatgtgcagaactcagaacttctcaggcctggtttctgtagtgtcaactgacaaccacatgctttgaaattttgtttcctttaattaaccttctccattttcaaatcaattttctcacttcctcatggtgttactgctattctaagaaatgcagacctaacggatcaacatttcaagactccaaaggttcgtatgccaagcctggaactttgtacacaaatagatatccaagaatactcgctgttcattctgtatacccaaacttaaaaattcaagagctaagattaaagtatcagaggattgagtcctaatttactatttgaaatctggtctaccttgtataagaatcttttcttgtgggaatgttgaagatttttgagaaagagaacaacccactgaaggccctccctgtttagggaagattaacctgttaggtgctagtagattgatcgaaggggatgatctgcatgtaccatgactgtgaagacagattaaaaaggaagaggcagataaaagacatattgtagcggaatccgctagtgcccagtccatttttccagagtcttagcacttcactgtgttctggctgatttctaactgccagcgtctacccacctttagttgagtgctaaggaattcatacccccatgccaagcagcacttagtccacaaccggtaggagttgatacataaacagtccagctcccccgcactttgggtggaagaactctgagctgtgttgtattagtttcctactgttgctgtaaaaaaattaccaaaaactaaagaggcctaaggaaacatgaatttattactgaacagttctggaggccgtaagtttgaaatagaccttactgggctaaaataaagacgcaggtttgaagacagtacactattgctttgcaggatgctgaccaatcttctggcacaagtagacccaaactgtggtcagcttattctttgaaggagccttcttgaattcctcttctctttataatcaaaaccgagacaggagaatgtgctggtgaaaattcctccacactatgctgaaatcaatcatatcaggcctcatcttaatcccacttaatttaactgaatcctgccatttgatctaatccatctaatttaatcccactttggcacaatccaaatctagaatacttgagtcaaatcatctaatactccaagactagcagtagcctaccgtggatggaaaacgataacaaagttacaaggtacatagagtcagaatctcttgtttttcattctggctataaaaaaaccacatgatcttagactaatcacttaatctctctctgaccgattttatttcttcatgtaaagacagaattaataaaactccttttttgagagatttcagagtgaaatggaaaactgtgaacttgctttgagttctaatacaatagcactaatcatgatgatttgaaggacagtaaaccttttgtttttcccatgaatgcaggttttagtcaaatgccagcattctctgtacacttggtgctcctaaaacgtttattgtttttcataatgaagaataatgtcttatgcaaagcaatctattcacaaaccttctcccagttggaactgatatatgttgagccatctcagttattctgataaagcccctcactacatttgtatctaacttcatcacaaacaaatgatctcgatacactttggggttctgcaagatttaacaacccatggtgacttgtcgcataacagaaaacttgactttttgctctattttaaattacatttgagtattttttattgagaatctattaaaactagggctcccagaactggtctttcagtagtttacataataatagctacaataacaactgatgtctgcgtcttgcattatagttggcagtggcttcctatagttagatgttgcccaaacttcagtcatttttataacatcagcatgatattttgccatattttcttaatttacgtggtactaactaccaagtgttttatcttgagttaccttttaaaatttaaatgtttatttaaaaagtgaacttcatatcactaccatacctagaaaacaaatattgcttgccataaatagaaaataaataaattcattgatttaggcatgccataaagtatacatatagcaaaacatcatgttgtgcaccataaatatatacatttatatttgcaaataaaaaataataatttttaaaaagaaagtaaataaatgcaatgcaatgaaaacaaaacaatattgttcagttcctttctatactgttgttgggtaaaagttcctgagcttgagatacattcttttgtgtttgtgtgtgtaagtgtgtgtactagagagaaagagagagagagatactcgcatatcttatatcaaatttagatacaaactctacattgagacttttggtgaattatttacaatttttggaaatgacatgatggattagaatcttagtaagcagtgcagatactgtatccattttacagatgataaagctagggctcagagagattacatgacttatttcttcaatactcagtaaatggcagagctgggcttcaaacacgagccctttcattccaaatcctgtgctttctctattgcactcaaaccttcttggagtgagaggggttgcagagggcttagatgaagcacactaaagatccattccctctgtcattcataatccagtcaaggagatgagagggaccaaagtcatatatttaagttgtatcaagagaaagtaggaaagtatgttttgacataattggcccaaagaacaatggtgaaaatatttagcaagtgagctcactgtaagttggactattagggaagactttctggaagaagcaagattaaaactcttgtgttgaagggtggataaaattagatgaattgaagatagaggtgaaaccatttcaagtgataacagtgctttgatcagaataatcaaaaatatcaaagctctgtcttggttcactgcagataggggaaaatgcacatatatgacaggaagtactatggctacattttatagtcttatgtgctatgaagtatgtaatcatagcacataagaatgaatcactattttgtaatccttaaaaataaattatttccttcaaaatatgtatgactcagcaaactatctacaggactttttctcctaaggaaataatgatggatatatgctaatatttgtaagaatgtgtctcatcctagcagggcaattggaaataactccagtgtttgatcatatagggcttagttatataaaatcaactgcatcaatactggggaccctgtgcaatctccaaaaaagatttcaacctttgctactaaaacgtgatctgtggaccaatattttcacctatacctggaacttgttaagattcagtttctgatgtagtaggtctgggggagcgcctgagattatgcatttccaacaagttctccagtgattcgcacatgcattaacatttgagaagcagaggcacatgattaatgacatggaaagatatttgcaattaaatgaaatagggtgatttcataattagttccatatgatactatattggtaaattttaaaaaatatgcatacattcacacataagagaaggaaatagggaaagagagagagagagtgtgtgtatgtgcaagacagacagatgggaagaatacatattaaaataccaacagtggtggaattactggaaattatttaaatttttttcctgtgtttgtgtatttgcatctattatgaacatgcctctttcaaaatataaataataaaactatattttcaattccttttctgttttcagaattttactgagttctttctggaaaaataaacaggaaccaagaggctgaactggaagaaaacaactcacaactcacagggatttaatcaatgtaacaagaaactgtcagaagagagaaagacttaaaagataagaattttccactaagtgtgaaggaggtctgtgtaaccttcatgtccctagtgctcttggaatttattttaaaaaccaaactttttttttttttttttttaagtaaggctataaagctccaggagcatagacattttcaaaactgccaactgggaaagtactttcaggatgaaacagatcggtttcccttaacaagtatttctagtggtattactctgagttctggttgggaatattccagcaatgtcacttagaagttgaaagaggacccagctgctttgtcagaatgattctttgcctgccttctcccttggaaaatttaccttaatctttattcatttctgtgagttgtccccatttgggtgatccctttgttctcagcatatgatggtaagaaaaggattcagattccagcttcactatttctttgctgctgggatatttaggcaatggaagtaagttaagatgattaaatgacataatgcaaataatgattaaatgacataatgcaaataagacatttattataaaggaaatacttaaaaagttgactgattgggaactggcattgtggcgtgactatgaggactctctggggaaagatcaactggtcccaaacagaactgaagaagaagctgttcaaccacctgtgggtattgaactgggagtggtgtctgaggtactgggtggttggggctgtgatagaccaggggctgctcatgcagcaccacctcaagaagtgggcatccagtgcatgtaccaacattactctgtccaggaagaagcacagaaaacttctccagcagatccagcttgcccagaaagagaaggcagccatggaagtggaagccccccaaaactagccaggactagtgagccacagctcaaaaggcaaaagaggacaaaagccccctaggatgaagaaatgaaggacctttgaacatctttatttctgccttcatttcgttatgtacccagtagtcattcaggagcaggttgttcagtttccatgtagttgagcggttttgaatgagtttcttaatcctgagttctagtttgattgccctgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgagttcaattcctgggtatccttgttaactttctgtctcgttgatctgtctaatgttgacagtggggtgttaaagtctcccattattattgtgtgggagtccaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatctttctccatccttttatattgagcctatgtgtgtctctgcatgtgagatgggtttcctgaacacagcacactgatgggtcttgaatcttttttttttttttttttgagacggagtttcgctctgtcgcccatgctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagacggggtttcaccgtgttagccaggatggtctcgatctcctgacctcgtgatccgctcgtctcggcctcccaaagtgctgggattacaggcgtgagccaccgcgcccggccgggtcttgattctttatccaatttgccaaggagaacaaagacacaacataccagaacctctgggacacattcaaagcagtgtgtagagggaaatttatagcaataaatgcccacaagagaaagcaggaaagatccaaaattgacaccctaacatcacaattaaaagaactagaaaagcaagagcaaacacattcaaaagctagcggaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagaagaatcaaatagacgcaataaaaaatgacaaaggggatatcaccaccgatcccacagaaatacaaactaccatcagagaatactacaaacacctctatgcaaataaactagaaaatctagaagaaatggataaattcctcgacacatacaccctcccaagactaaaccaggaagaagttgaatctctgaatagaccaataacaggctctgaaattgtggcaataatcaatagcttacgaaccaaaaaaagtccaggaccagatggattcacagccgaattctaccagaggtacaaggaggagctggtaccattccttctgaaactattccaatcaatagaaaaagagggaatcctccctaactcattttattaggccagcatcatcctgataccaaagcctggcagagacacaaccaaaaaagaattttagaccagtatccttgatgaacgttgatgcaaaaatcctcaataaaatactggcaaaccaaatccagcagcacatcaaaaagcttatccaccatgatcaagtgggcttcatccctgggatgcaagactggttcaacatacgaaaatcaataaatgtaatccagcatataaacagaaccaaagacaaaaaccacatgattatctcaatagatgcagaaaaggcctttgacaaaattcaacaacccttcatgcttaaaactctcaataaattaggtattgatgggatgtatctcaaaataataagagctatctatgacaaacccacagccaatatcatactgaatgggcaaaaactggaagcattccctttgaaagctggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgactgtgtatctataaaaccccattgtctcagccctaaatctccttaagctgataagcaaattcagcaaagtcacaggatagaaaatcaatgtgcaaaaatcacaagcattcttatataccaataacagacaaacagagagccaaatcatgagtgaactcccattcaccattgcttcaaagagaatgaaatacctaggaatccaacttacaggggatgtgaaggacctcttcaagcagaactacaaaccactgctcaaggaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaaccccaagtcaaaagaacaaagctggagccatcacgctacctgacttcaaactatactgcaaggctacagtaaccaaaacagcatggtactggtaccaaaacagagatatagaccaatggaacagaacagagcccttagaaataatgccacatatctacaaccatctgatttttgacaaacctgacaaaaacaagcaatggggaaaggattccctatttaataaatggtgctgggaaaactggctagccatatggagaaagctgaaactggatcccttccttacatcttatacaaaaattaattcaagatggattaaagacttacatgttagacctaaaaccataaaaaccctagaagaaaacctaggcaataacattcaggacataggcatgggcaaggactgcatgtctaaaacaccaaaagcaatggcaacaaaagccaaaattgacaaatgggatctaattaaactaaagagcttctgcacagcaaaagaaactaccatcatagtgaatggcaacctacaaaatgggagaaaattttcgcaacctactcatctgacaaagggctaatatccagaatctacaatgaactcaaacaaatttacaagaaaaaaacaaacaacccatcaaaaagggggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacactttcacactgttggtgggactgtaaactagttcaactattgtggaagtcagtgtggcaattccttggggatctagaacaagaaataccatttgacccagccatcccattactgggtatatacccaaaggattataaatcatgccgttataaagacacatgcacacgtatgtttattgcggcactattcacaatagcaaagacttggaaccaacccaaatgtccaacaacgatagactggattaagaaaatgtggcacatatacaccatggaatactatgcagccataaaaaatgaagagttcatgtcctttgtagggacatggatgaaactggacaccatcattctcagcaaactatcgcaaggacaaaaaaccaaacaccgcatgttctcactcataggtgctgaacaatgagaacacatggacacaggaaggggaaatcacactctggggactgttgtggtgtggggggtggggggagggatagcattaggagatatacctaatgctaaatgaggagttaatgggtgcagcacaacaacatggcacatgtatacatatgtaactaacctgcacattgtgcacatgtaccctaaagcttaaagtataataataataaaataaaataaaaaaagaaatgaaggaccttgaagatgagagctaaacctcttcctctagaagattctcaactggatccagaaggactcagtggttgtttcagaggactttggcaaaagcagtgccccttttcactcaccagatttcctcctccctaatcctcctgtggaaggatgtctttgggagagaagagggtacagaagaaagattggagaggggcctctttacaagtcaactccatttgtaataaagccctagcactctgaaaaaatttttttgactgattaattcatcattcaacaactgtgtaccatgtgaccatcatctgcccctatgggtagaggatgcaaatgatcccagacatgtttccttacctcaagatgctttcaggtaaggggacataaccaaggaaaacacaattacctgcagtgtcacaagtgccatgacaaggagagggcccggtatcacaggggcaaataagaggagtactagccctatcaggggggtggtggcggtaaagaagtcttcctcactgaagtgacatctacattgagatataatggaccagtaggtctcggccaggaatagctgagaagttccagacagtgggaataacacatttacaggttcaaatatgagaaagaacacaaatgttcaggtgctcaacaaactaaaagtgctaggatatgagtctggggaggaaggtgggggcagtagaaagaaggaaaatgatatgagggatctgtagagcctggtcatgaatgggccttgtcagccatgcggaggaagtttcacttcatccaaaaggctgtgggaaagatcagggtcaaatatggtctcatgggggttttaggcagatcgctctggccacaggtcgagaaagactagagacaagccaggaggactgcaaatcagccagctaggagggtgctgcaggaacacagggacaaatgatcctaccctcaagccagtgaaatggatgactatacatgaaatgagattggtgattaactggaagttgggagatgatggaacagactcagagaatgtacttaataaatgcctattttcttttcttctccatagagatctattggccacttcaggccaaggaaagattaacccagtagtagcagaaaaaatattttctagaagcaaaataactgtgtgcttagcagttctgtaagtaaggtctgggaattcttgagggtcactgcatttctatttgaggggtctgtgaggtcaaaactattttcataacaattctaagatgctgtttgccttttttgcttttattctttcacaaacatgcagtggattcttccagaggctacatgatgtgtgataatgcaattgctctgacggctaaagttgtatgtgcttggattttcttgagctttaaattagtcccagttttaatttcaaatatagtaaatacagaaagatacagtcctcatgacaaaagctctttggggtcctcaataatgcttaagagtgtaaaagaaacctgaagccacaaaatttgacaaccaatgccataaacatttaaagaacattttaaaggcatccactaccaaaagcttaaaaaaattatgagtgaggataaactctactgattgaggagcctaattcttatcttagttttgttgtcctttcaaatctgagccattgctggcttgatataaagataatgcctaggatttcatttctagaagaacacatccaactaacaaaatcaaagcacataccatacaatgtactaagtagaaatatgaaatccatgtccgcaattctgaatatactttcttctttaaacttatttttaaagttggaaaacagagtcactgagtaatactcataccttagaacaaaatctctgttgtgtaggcagaaaagcaaaatagaagcgataatgtgggcaagtggaaaataacacagtgaggagaaatgatacaaactagactcagaaccagagctctaaacgcaagttgccaacccaaaaggacttcaggatcccctatgaaccattatttcaaaaaacaagggcagttggctagccaatcaagcataaatctggtagtcatccacacatcatttggagaggcctggagacaatggaggacagttttctgtgcccctgaacaataccaaagtggctgcccttccaagatgtcagtaggtgtctcagcacaaaaagtctggggaaggtcaggataagagcaatacagaaaacggctccagagactgaggtcagtcagttccacgtttaggacgaggattccatatggctgttaggaatgtgatgtggctagtacactggaggaactgaatgcttaattttatttcattttcactaacataaattcaaagagccatgagtctagtaatgaccacactcgagaactctattccagaactttagtgaaatgatctttgcaacctgtggagagccaactataagatctcccatcatggtgcaagatgggtttgaatgtacttttcaggtaaacacatatgtgaaatccttgtttcccaccaaaacccattcagctgcctaggacatctgccagcaaagccagctagttctccttggggagtttggaataggagcttagtaaagagggaagcagagcagacaaatgagaggcaggagtcttgcctgttaccctatgtgacctggccctgagctatcttccaaattcttttcctgatctgtagctgcttgtcactgtgctccagcgacacacaccctctagttcttcctagaatataccaagcaagttcccatctcatggcctgttgtgtttatttactttcttcttatcctggaatgctctttctctggatcagggtttcttaacttcagtgctagtgacattttaagctggataattctttgctacagggacctgccctctgcagcatagggtgtttagcagcatccttgttctctatccaccagatgccagtaccatacttaccccagttgtgacaattaaaaacttctccagacaccaaatgtccctggagaggcaaagtcaccctggttgagaatcactgccctagatatctgcatgattcactttctcacttaatttagttctgtactcagatgtcacctccagggaatctttttcaaaaccctacacctctctgtcccctttccctgttttatttttcttcccagtatttatcactagctaacatcatatcagatacttctttgtttcttgtttctttgcctgctttatttactgctgtatgctagcacctagtatctagttgattggtagatgctttataaatatttattgcatgaatgaaggaaggaagtacctgcgccatttgtaaagtcaaaagagagacaggaagtttgcattctgggagaatggacacatgtcacaagcagaaaagctgtaagtcaatttagctattaaaatctgtattggttgttatataacaatgataaggctttagcacattttctaataatgggcatacttttactgaccttctctaaaattatgctttgaatgcgaaaataaattataattttaaatgtatttgtcaaccacttttatgaatagtatgcaagtttgagacctaaaattgcggtcatttcatatcatcaagaatctatgttcttacctgattttaacattgatgtctatttgcctttgagcaaaagaccttttgataatgagaagaagtcctgatgaaaggcctgcattttccttcatagttataaattgaaaatgtgtttccaagaggtttttattagcattactgagtgtaagcctatcaattcagtaactccagccctaggaaatttaatcatgtgctgaagtccttacttactggtaagattgagatttttttttccccccgatgatttgttataatctttctgaattcctcaagaatactagatgaatttataagatgctgactttcttctggaagaactgtaaatattcaaaagaaattacaagcaccaagtaaattgcacattttggagactaagggaagaaaatccccaaactgttggtagatggtcagagtattctcctacaacctggatctagccaattattaaatgaagttccataatacctcagttcctaaaaatctccggggactaagaacttctggatatattaactagaatttttaaaagttaagtaaatctactttcacattttcaaggtttttactgatgaaagtctttctacaacaacacacactgctatcctttttaataatagaaaatctggaactctgcgtgtgtgtgtgacctatggccacccttttgtgaagctgtgcatatgcacaaacaagggtgggtgcaagtctcagaattaggaccccaaaggtggccctacaagttgattcctcttccagatggggtgcagcactcgcagaaccataaaggcagcatcccaagcctgccttgtaaaaaaactgactgctgaatcaaaaaccaagagcagcccttccctttcagggttatcttgattctttaaaataaaacaaaataaaataaaataaaataaatcgccatctttacttctgtttctagagtctcgtcaacttttcagtagtcctctaaaccttgtttgtgatttgtacagtcagccattttggcaacccacatcacttaccttttcccttcactatttgtatggaggagaagcattccttatgagtcatttgagtattaaaaaattttttttgcgtatatctatttaagatatacaacatgatgttatgaaatacatatatagagtaaaatggtcattacagtgaaacaaattaagatatctatcatgtcacagttatccatttttcccctctgtggcaagggcagctataatctactcatttagcaagtatcctgaatacagtatgctcttattaactatagtctttatgtcgtacattagatctttagacatgtttgccctacatatctgctactttgtagagtagaggattaacagtggttctcaggggtggggtggagaggaagcaaatggagagatgtaagtcaaatgatacaaagtaatccaagaatttatgtgagaagaagtgggaaaagtctatttctaaggtgcctcaacctttccccctaactccatccttaccaccaccaccaccaccaaacaccgtaataataataataataatcaggaaattaacacttctaaacacctgatgccagactacattgtttttgaagtatttcccaatgtcaagctttgaacagaattatagatacctacaaaatacattttcatgaacaagtttgagtgttttgtatagtatttgcaaggaatatcagagtcctcttgtattttcttttataatattttgctttctgaaaaatatctcagttgatacactgacaggcagaaagatgatcaaagatattaaccctgccccttcaagattagagtcataattgcctagctggagagggaccgagtatcctcaagtaggactcaggtttgaaataatatttccctgaaggtacaaaaaaatgatggaaccccttgggaagtattccacatccatctgtgtattagcttgttctttggaatcaacattatggctcctcagatacctctgtgctaaggatttttttctgaaagtcgaaagttttatttttctacaagaccactccctgtaggcacagtcaacctgtcctcattgtgtttgaacccaggtacagtccacaaataagctggcaaatgtgaccaaggcacaccattacatgctcctcagagggctggagggtacttataaatgcattctcttgaagaaagaagcaattggcaatttttatacagctgcattatatgctgattatgtacaaagcctaaaaccaggcaaagtacctagcagaaaatacccatgcattattcaactaatacaaatctgttgtttttctaatttgctcttccaaacatgtcttttcaagttcttttgagttgcagttgttttgaagtgggggagaagaaaagttttctctcttttcagggacaaaaactcaaataaaagaggtacccccattcagctaatcatggcagctttaacaatatatgggcaaaatatacaacttacaaaattagaggctttatgaagagcctccctttataaccaagttattttagaacagagaaagataaataatctacttatcaggctaggttttccaggctttcccattccaagtcactctatgttttctttccttctttttctatttctcccttttgcctttcctaatccatatcgcaagataccatgtgcaacacgctcacccctatttaactgcacctgttcacagtattctacagtcaaaagctctacttttgcagcaactttttattgatgaatgcattttatcctgattacatgacaatgatgatggcttattcattatttcattcagcatacttattgtgggcttactatgtgccaggaattgtgtgggtcccaatgatagatagaacagggttcctagcttcatggagctcccattcactggttaactacatgtatgaaggctttcagtaaattttgtttgcagtgacattctcctgtgatcccaggggagatctgatttatcctcacatcaaatatgactctcctgaacaacacggtggtgttcttttagggctgatgtcttatatttgcctttaggccaatcatatcttaagagactgctgagacctagaatagctttttgataagcccctttgcctacctcccctatctgaccctttctttcttacaggctcttggtgtttacagtttatagccactatcatcatccccattcccatagtctcttttcctttcctattcttctgttgtttgccacatgttttctgcttttttatctttcttttgtcttggccatatctgaatgctttcagtctggtccatcaatggcactactataatctctgagtttccaggtcttcttagttactattgttatttttgtatgctcaaaggctgggtaaaatattctttacaacacacattcattggttccaccactgctcctttctcccccatcaaacatagttcagtgctattccagatgtttgaagctgtttgtgatctgatatctgagttctggataatgaactactgcagctcactttgccagagacagtgagagttcttcccgacatatgaggtggactcacaatatttgataagatgtagaggcagaattagaaggtaacagttaatgactagcatcctggaaaacaggccaaagggctccaagttttgcagtgtatttctatgcaaacttgagcatattgtgctggttcactgattctcaagttttcagaaaagaaaatgggaatgttagatcacaaagagagatacactaaggttccacaggaagaagatgcctcacaagtagcccagtacactccagtttattttgaaatggtgatggaatgaaatggttaggtaagtttagttctttgattaaccgagaattaccatatgcactatagatgaatttctaatttttaaataatcaggataaaatgcatttatcaataaaaagttgctgccaaagtggttgcctcagaggtcactaagaacataacaaccaaaaaatcctattgatttgtctttttaaaagagttatagaaaaatggaagtctatacaaagccatctacattctaatgttaaactactcaacaataaagttacatagcatcctgttcacttgttctgggcctaatctattgcttgagattctaaattttttagctgacttttaaattattttcttagttgttttgtacaccttctcctctttttgctatgactaaaatcatctgaagcctcttgcagtgattatactggagtaggcttttccattaaagggtcatcaaataattagttcttcagtgaccccactaaatgaaaattccactaaaaactttagttacaagaagaaaatcctacatgtgttaagatctaatcagattgggatgtctaaagacaaatataatggctagatgatttaaaacttttttttttttttttttttaaaacggagtctcgctctgtcgcccaggctggagtgcagtggcgcaatctcagctcactgcaacctccgcctcccaggttcaagcgattctcctgcctcagcctcctgagtagctgggattacaggcacatgctgccacacccggctaatttttgtatttttagtagagatgggatttctccctgttggtaaggctggtgtcgaactgctgaccttgtgatctgcctgccttggcctcccaaagtgctgggattacaggcttaagctaccatgcctggctgatttaacactttttttttttttttttttttttttttagacagggtctggctctgtcaccaaggctggagtgcagtggtgcaatcgcagctcactgcaacctctgcctcccaggctccagccattgtcccacctcagcctcctgagtagctgagactacaggtgtgcaccaccatgcctggctattttttttttttttttttttttttgtaatttttgtagaaacagggtttcaccatgttgcccaggctggtctcgaaatcctgagctcaagcaattggcccgccttggcctcacaaagtgtggagattacaggcatgagccactgcgcccagccaatttaacactcttatagcatcacacgttactttgactgacacctgtggttcttactggcagccaggcttatggtcactgcatcacggacactgaatgactagacctcgacatgaatctcatacatgttcaaatgcttatgtaaagtttcctgtgggaaggctttcttttagttcattgaaagatgacccattttcagtcctcttcaacttctggaactttaaagtgtggtgtcaacttatttccctcatgactctctctgaatttatgctggtttcttgccgtttgagattttagagctggtctgtgaaagtgggacacatttcccttgacacatttcaaactatttgagaaagaagaatccaggtgcaataagctgtcacactgaatattagaagaaagcaatcaagtcctttgtaaaaggagtctcagtcacctctcttctacctctacttcatataataccacaaattgcaaggctcctgaggaatcttccttctgggtataaactgctaagactttattgcttgaagaagttttctgggggcatagcttgctagcctggtgctcatagtcacaagacactcttttccttggttactagcattgagctttgggtaggagcatctcattattcctctggggacttattacaacactcttgtcaccaaattagtagataagaaagtgtggctaagatgttaaaaccttgaagataatttgctacctggttgtaatttctttagcactattattcttgttcttgtctgacctagactactccacatcatgttttgctttatctgagttctttacaacactctcagagaggagttctgcctttaaccatattgcttcctagacttttgttgtacagagtgagagctgaggctgagaaatgagaggaactggactgcttgagagtttgcacttaaaacctccattaacgatagaggagaaagggcccagaaagttgagatgcagagcagagaaagaaggaaccagcctgggttgcacttaggaatttatggaaagtttcatttttaaaattaaggtcaaatcttgagtacttacaagaatatcagcaagttcactgattaaataaaaggaatttcaaactagacaaacttcatataactacctagatgtctgagaaggtttttatctcatgtttttatttatccttttgaatcatgctctctttgggtttccattagttgcacataatagaattgatcacacctagaaactgtgttcatcaatgcacacacaaaatatatacatacattgttatgtgattgcaagcaaaccacagtagctttcatggtctcagtcttcaactgaggtaactctgaagtccttccaaatcccactgaaactctatgatatgattcacataatgaaatttctacagaggctgggaagtgacataaatgaatgaactaggctggaggtaaaccggaaaggctatgttgctagtactattaggttggtgcacaagtaattgtggttttcaccattaaaagtaagtaccaacctaatatgatcaagaaatgtaggtaaccctttctttgctatattgccttttttctattaaaaatttaaatttgtaatttattattatctttaatttcaacgtgtacctccactatctaaaataaaagctgaaaatattacatcttaagaactcctgggtgtgccccacaaaacccaaccacactgatctggggctttggggacatcactttgacttattcttagaatctacaatagtttaccagacactgtgaaagagctgcaaaagatggtacacaaactgttcaacaatggcgtggagaagaaagtgctgagacaccatggtctgaaaattcaaggtggaatttcacagtgaacacacggattatgagccctgaatgaattcctaactggtccctgagcgttgttaaactgtggaactgctagaagaaagctgtagctgtccatggtgcttaagaattttcctcaatgctggagtcttggagtctgtggtatggaaatactttacactgaacatattgtatattaacaattacaatgacaacccccccccccaaaaaaaatcaccttgatgtggctcaagaggattcaatgtatttctgactcatctcaataacaaacacttaaatagaaactcatattcttgattttctttttgtagttctaaaacaatttgtgtatatgtggaatgatgtgtgtgtgtgtgtgtgtgtgtgtgtgtgtgtgtgtgtgtgtgttgtatctctaaaagcttctaccagcatcacatatttccttgatgttaatattttcaagatttgattgtctacattcccaaagtatagtgcttgacacaagtgactgtttaggtaccagcaattctgctgtggagtgtgtacaggaatatcagtttctgatccttcttcccataagtttaactctatggtaacaattaccttttataaatttaagaaaaatcactgttgttcaaagtaatgggatttaaaattcctcagaataaactaaaaagaaagaaagaagttgaaaaatcacatctaatccccaaaatttccaactctgaaaatcccgctttaaaaatacaactcacctggtttattttaaaatgaaacatcaattctgtatattcatagagacccagagcaaaatgatttcagctggatttcagttacagtaacccttttcatcataaatattctaaaatgctgaccctctgttgatactggctagaggaatttttgtgtgtatttgaaattacttattattttggagccagtgctttaatttgactggtgcaccaacaacaaaagaagagaagacagaaatatgtgttccaatataactaaacattaaagtcttctttcctttttcacaatgaagttttaaaagctttaaccatgagatgataaatctgataaaatcagggcaattaataaagaaattaaataataaatgaaaagaaatcttaaaagcattaaaataggaggctctttaaagtgtcatttaatctccatcatttcagatgctttatgtgtcttcatcacatcattcctatgactttctaatgaaacagttctatggtcctcctaaattaatcattccaacacataacagccttcattttgagaatagtttcatcctatttaatctttgccatataaactttatttcctttgtgagcctttatgtttgtgtattgatagagaaaacgttgtcattattcttcacataactgaaaagtcactaaattagtgaggttcattgctttttttcagataaatagacctcatattttcaaactctctttgtctgtcttttactctccatcttctaatataaggttattttgcataatacttttccaaattcctcataccccattggttaggcaatccctcctgagaggggaaagcatcctagagactacctgtcagatgctattatagttttcgtacatgttacttccatggtcatgctcaaatccaaatggaaattacagagaagagtatttaagtagttctatgtatagtaggaagtgggtgctaatagatttccttaggtgaaaaaacctggatttcagaatgctgaaacagaggaaatcagataccatcttcaagagtgttcttttggaaagtttatgggattatcaattctcttgaagtaataaaaatataactcttcatagctgttaattgagctgaactgagaatgctaggttcaacatatattttggtatcactttaaaataaaaatattatgactttctatataataacaaataaaaatcctgtctcctttggcactattacatctttgacagaaaagctgaaaatagttgattaatatttggtttgtaattctgatggtatacctaaaaagtgcaggataagtcaagataatctttaaaggaatcatggggtatttatcgaaaagaaccagttaataatgttacaagatgcccattaggcacaggcatgtgaattaggttctctgggaagttaagaaataggatattaaaaaaaaaaaaccacgatattcaatccctatcttcaaggtactaacttttaacttgaagagcctatgcaacggaaattccagtgtcagcatcatatgacaaaacaaaaaagaagatgacccccaaacaatcttagcacatatgtattgttgactttggctgggaaggacaggcagaaggagaaatgtcaaagagtttctagagcatttggaggtgctagacccaggtgaagctcgtatggaaagacagattttgactgatgttgtgaaaggctattttcttgtcctaatagaatctggaaggtcacctctgaaagtaatgaaattctttctgcactgcaataagattgttcaatttttaattcaaggaaaatcccaaagcaaacagcacataaaatattggggcttgggggtggtagtgataaaattatcatcaacatttaaagacctgtcaatctaagcatgcacatggatccattttaaaataaattatattgtttttcaatgacagatgccatttttatcatgcacattcctgcaatttaatttacaataaatctccaaatagcttaaggcaattattttaggtagtgctttatctagcagtcatgtcatttgctttcttattctatttttgttgcacagatgtgaaggagttttaatgtatttcatatttctgctaacaataaagaaaaataagatgcaccaaaaaagaatgagcccacaggacatctggtactctcacctcatttaaaaaaaatatttaatacaggtgtttgtattccaaccattctatcatattccatttaatttacagtcaaggttccccaccaaaccgtcttaagccataagctgtgtctttcatcgtctcataatgactttaacatagactctgtgaaataagcaatttttgccatatgactttaggatcgagtataacactagaagggactccaagaaatatcggggctattaccttgtgtcccagtatagttgaatcagatatggacatgtcatttactgtcttattcatagaattcttcttgaaatctaatttcaggagaatttctagtaataattaataatagaagtccagggccagaagcaaagagagaaaaaaaattatagcaaaatttgcaactcaaaaagtttttttctacatcatacttcaggacagtagttaacaaaaaaagcttaattggacaaacattttttgagagtctactagatactgagtgctgtataaggtatgtctctgttgatgtgagcattttgccatactattttttattaaaatttacatttgttggaatgcatttaactatttatatgcctttaatttataacctaactcatgatataatctgatttgtgctacactcataataatgtcaacaccattataatttttgccataatctcataatttaatttcctatatagtgatatcaatactgacacatttgttccacctgggacagaatgttaatgcttttggagaagaatttaagagcaagtccttctggaagacttcttttttggataattcagaactacaaagtttggtggatacagaatcatgattaatctcacacttggttaagtgcatagctgatgttgctcaatcagacttaataaggaatgctaggaagagaatgatgcttctacacagcagcatgtgataacagctgttttccaaacatgacacaataagagcaagtcattatctttgagaaaggtgatgccttcaaagattaaaattcaataaatatttgaaagacaactttgcacaattttgatttgtaaaagatgaactggggaaatgtctaaacaacttgacatgccttttgccttttttggagtgtgggtagaggttgggaggagaccctgctaaaagctaacattattaatacaaggtctgatattttacttccttttcagtaaaataatgccaagtgtctttatgacatttgtaaacggagaacattcagcttatgcccaatctaattacctccagttgcttttaattccaatatacccacattatgaagttcaggaaaaattcattcttagtttaaaaagggaaataaaaaatatttaaagtctttcaatttctggtttatgcacaaattttgacatatttagaaattcaaacctctttgaaaccaataaggcgtatttcaaacacaaacaccagttagattagataccattaaagggagactaataagcaaactacagttaaatccaaaatcctacacaacctcaagcgccagtcaaatctcacctcttccttgtagcctccccaacactccttgccagaggagctcacgtgcttcaaaacctttccagcgctggtctgcaccatccaaaacctctgtcttatactgtagttatatttattcagtactgtacatgccagtggggtaattttgtacccctagaggcatttttcaatgtcttgggacatatttgattgtcccaactggagagtgcgtgtgctaccagcatctagaaggtggagaccagagataccgctaaagatccacagtgctcaggtaattccccccacaacaaagaaatggtgctcgggctgagaaaccctgattatatcctgcacactgtacatctggtaagtggttaattttatattgcacgttataattacatataactcaatcagttgttttctcagtagctaaaagagtgaatgccaatccaaatgtgcctcctccagaataagtaagtagtttaggtaagaatttggctcaacattttatttttattctatcttggcttaggatgacatgcatacaaactctgttgaatgttttgataaaaactttcagagttggaggtaaactgtcttcataataagctattttcctagggcttcgttatatacagcacagcatttttttacagcattttattttatgtgcacatttatttttgccactttttaaaggaaatatgtgcaagaatataatgagacggtatatgaataaagattgcagcattaaaaatacatataaaggccaccatgactgcaatttttcatgagtgagaatttggtgagaatagtttacatgctctcctcaatgtttctaaagacacaacactgaatggaagtaatatggacccacagatcagcactcaatgtagcatatcttagaacagctttttccttactcccaggatacacagctgctgcccatattcccctctggggtacagttatgtcagacttgaaagaaaaacccaattcctgctctgccctggtccttttatatccagacgtatagagcattggggaaaaaaagtatgctttcagtatacaggcttcttattaacaaggaatatttataaacactgtgacctcctgattcctgaagcaaactcagctctagcgaggccacatcctcactgaagaatgaaagcggagtcaaggcctatgagccctgatcaagatttctgcctgcagctttatagttcctcaaaaaccagtctccctggagtcacctctttgcgcacaaacatttcacacagaacattgcgtaggattatactttctctcaataggtagtcttcttgctgcagtaataacattctaattgcctggaaaggaatataacttcaagagtatatgcaaccaaaaggtaaaagtaaaagacaaaatcaggttctataaactctagttctatattttcgtgtgtgcgaatgtgtataagcttgtgttattctcatttatgttgattttgtttgttcatcttgttttattttaataagaaagcaaataaaattgcagtgtggttccaaagagcaatcagaaagcacagcactccctgcacaacaggaaaaggaacagaagagaaggttgtgattggctcctggagacctcagcaaccttctccaaactgaacagagtataaaatgtgattttgctctcttcataatgattatcaaattcctgttggctaatacaattatttggcactaaatatcctctacttgtcatgcatatgactcacttaaaatcattacaggatggcattattcacatatggttaacatagctaaattcatttgcagtttaccaactgttctatagaatatttttgcaccctgtagaattgatctatcccaaggcatattcaacgtgatatacacagcctttcttttcttttacaccaacggaggattttaggctggctttaaagttctaatgaatgctcctgggtacattttgttttttccttcatgtcagaaagatggtattttatttatccctaggtagtacatgttagatcatcatactgtcagagacctctgtgaagtcaatcccagatttattgcttgttcccatttccttcaagcacctacaacatttgggctgaaacttcgtcatgattaaagaagcaaagattgtatcaccttatttatcaggaaagaaaagaaagcagttctgtgtctgtgggctctaccattcctaggttcttcctatcaagcaaatctgctggcatttaatgctatggcctcagtttaagttgacatacatattagacatttttatgtggataaaaccaaagaagagggggatctgtatacagtgatattttgatcatcacccatgaaacaaaaaaagaatattttagatataatccaaatttttgaaaagtggccttaaataacttacatcacattaagccggtgatcattttgcattagagttttaattctccccactatcttccctaactcatttttccccatagcattttgcactctcctacacactacatcatttagttatttattttgtactgtcttccctcccctacaagaagggaagctccaagcaggcagggattttggccagttttgttccctgcaggagctcagacacttagaacaatgactagcatgtggcagacactcgtacctgtttgttggatgaatgaatatgacatcttccactctttctccaattattttttaggcattcaagtaattttgctataaatccttttccagaagaaagaactttttaaaattaatttatcttaagtgtggaaaagaagactctgaaaaaatatcctatagtaatttaccttacatccctctcagcaaaggtctgatcagttttacatttatttaaaaacatggttatttacttttgaaaatcagaaactacaaatcgagatcatttctatctctttctcagaggggaaaggggctacttccagtctttgtggtatatccctaaaagttcattaaagtgaaagaaagcaggttaaccctgaggacctaaacagctctgggaggtcagtgttatcagcccttttcaagtgaaatggctgaggctcacaggcttccactgcttgccaggtaaggaagtggggactgggagtgggattaggtgtgtcggctgtggaggccatgacctttctgatccgtagtcagacacattatccatggcacaactggcctttacccaaggctgtgccctttctaagagcagcagttccactccaggaccaaggcgtacagttcctctatctcttgggtatttaaggttttcagaaaggcagatggtctcacttgagttgcttcgtatgactggcatttttaatgaattagtgacagaaaaaaaaaaaaaaacttgactcactcccagctggataacttcacaaatgccaagctgaaaggaatgatatctcataaattcaggcaaatgggcattaaggggactaagctggctgttcttttaatataccgagtattagcattttccagggcttcaggtcggtaatgcagtttcagctcaggagactacacctttcattaaaactcttttattctttctgctttgctataatgaaaaaatcttaacctgtcacacctgtagtgattatagaagggtctcaactctggtggggagagaagctcagaacaggcatgtataattttcaaagaccacataactgcttcaaaaaaaatgacagctgtcaccaacattttacatccaaaaacaagtttaattgttcagactggtgttttaaaaagctccagttattggaaggctcctcaatttttgtatagccagagactcaaataactctaggctagaaggttttatttactgatgagagagggcatattcaatatcaaaaaattgtcatttttatttgtttgcattgaggctgagactaaaaagccaagcagcacaccaaaaggagaaaatttactgtatgcaaattaaaagctaaaataattgcctgccatgaaaagaaaagtgaagcacaggagcctgaggtaggccatatttgacttactcatctttagaacaatcttaatgcccatcgtttcaccttccacatagtaaatagtaaatgtctggtgcatgaataagaataagaggaactgaatagacatttctcaaaataagatatactaatggccagcaaatatatgaaaaaatgctccacatcactgatcagggaaacgcagatcaaaaccacaaggaagtatcatttcaccccagttaggatggctattatcaaaaagacaaaaaataacaaatgctggtagtgactcttatacactgttagtaggaatgttaaccagtacggccgctatggaaaatagtatggaggttcctccaaaaactacaaataggaccactgtatgatccagcaatcccactattgggcatttatccaaaagaaaggaaagaagtgtattgaagagatatctgcactccatatttattgcagcactattcacaacaatgaagatatgcactaaacctaggtgtccaataacaggtgaatggataaagaaaatgtgttgtacatacaaaatggaatactattcagccataaaaagaatggaatcctgtcatccacagcaatgtggatggaacttgaggataagtgaaataagccaggagcagaaagttaaacagcacatgttctcacgcatatgtagaagctaagaaaaaaagggggtgatctcatagaagtaaaaagaagaaaagaggatacaagaggctggatagggaaggaggaagggagggctagagagagatttattaaaggatataaaattagagctagagacctggaataagttctagtgctctatctcaactatagaatgcctatagttaaaaatatgttagatagtttcaagtagctagaagaaggatattagacattaccaacacaaaaaaataatacatgtttgagatgatggatatgttaattaccctgatctgattactatacattattatatggatctaaacatcactaggtaccctatgaatatgtaccattatcatttgtcaattgaaaacgtaaaattaaaaaaaaatagaaaagtactgccatttaaatgaatgaatgccaggtcactttacccaaggctgcagggtacccacagcagcacaggtgtctccctcacttccttcaggcctctgaacaagtgtcaccaaagagaaggtacagaatgcagtgagaaccatgacaatatttcattgcctttaatgtagaatgagtctttggaaaatatttgaatgtgaaaatttatcttgaaggtaacttggcaatatgtatcaagatcagtaatgtgcaggcttttgacacagtaattgcatttatcctacagataaattacatagttatatttgtaggataaataattacataaatatatgataattatttaacgtatatatttatctgtccatgtatacagaggtagaattacaaagatgttcaatgttatatttttgtgattatagaaaacaacctaaattgcccaccagtaggcgaacagttaaatgacttcacaaccttaagaatgctaggccattatttcacaaaatgaggtaagtttatacatagcaacatgaaaacatatctaacttatatattaaatttaaaaagctagttgtagaattttatatctagtttaagagtcattgttttattgcttagaatacacacatatgtatattgacaatggttttcatccctttattgcctgaattgctaaaatatgaatatattacttttgcattaaaaatttaaacatgcttaaaatatttttcgatgcatatattttctaagcataaatgactacatttaaagtcacatttaatagtgtttaaatcatcactcctactcctttctacacttaaatcctataactcttaggtttttttttttacctttgataataaaattttttgacaatggaaaaaaagatattcatctttcaagcacctgacctacttaaaactgtcacacttttcagttcattttgcttcatagtccatttgttcaaatgctaagtgataattgatttgtcttgagttcatctttcaaaataagccagcataaaacaaactagtatacaacataaggcagctgataaatcaagtttagcaattcttctcatttatatattgtctcgatatcaagccccaaataaactttagaaggtggtctagctggtggaaaaaatatgaattttagaattatgatttatgtttgaatcctgtctctgtcataaactactagtataacttatcttctctgagcttcagtttctccatctgtaaaatacatttcttgtgaggattatacataatgctatggactgaatgtttgtgtaccaaccccacccacattcaaatgttgaagctctaacccccaatgtaactgtatttgaagatagtataaagaagtaatttaagttaaatacaatcataagggtggggctttgatctaatatttgtgtccctataaaaagagacacttaagaacacttgtttctctctctctctctctccgtgtgtgtgtgtgtgtgtgtgtgtgtgcatgtgtgcacatgcacacaggctatacaagaaaacagcaagaagttgaacatctatgagctagaagaaaccaaatcagtggataccttgatcttggacttccagcctccagtactgtgagacatagatttctgccgtttaagccacccagtctgtggtattttcttatagcagcccaagctgactaatacatgtagcataggtaaaacatcaaatataataccaagtacagggttgacaccaaataaatggtgactgcaggctgcccacacttttctttgcacagcaacctgttagcaggacctcacacatactggaactgtgttctcactttgcctggcagcgtaacctatacattgtgagccagtttgtccaaccacttgagcaaatattatctcttttgtctgtgaaatgagtatgacaatatctaccagggttgtgaggatttgaaaacatggaggagaagcactgagattgggttggcacatggcaggtgctcaaaaatgatacctattgctgtgttttttatggatgtccaatataagaccttaaagaactccttgttttgttaaaaaaaaaactcttcctggtgaacttttagacagaactgcaaaagggcaggtgcaaatatttgtccagctatggtcagcccagcccctgacccctagtgggcacattatgtctgctgccaaaactttccaagtggtttagcccccctggctggcattgaagaggcagaggttgtgggattaatttccacagtctgattagctttcagagaaaactctgacttgtagcttggaatgtcatagtggcctgagaccacctcttgaaaaaatactagcaatactggctattaaagagcatgagaaccccaacccatgcaactccatcagggctggcagcctttcttatttttttaaattaattaatttctttttgattgacaaataattgtgtatatttacggggcacagtgtgatgttgtgatctatgcataaattgtagaaagattcaatcaagctaaggaacatatgcaatgtcttaatgaggctttggcaatgtcagtcatacattagtatataatcctaacgtcgcaatctgagagctacctctcccccgtgtctgtgctggttctccctctgcagccactttgccaatcacatttcaaatgcagaacccaggcctgcctgtctcagggcagaccatgaaacagagacactggctgccagggtcacttttgattgcagggccagctgccctcccatctgcctgtcaggctggagaaaaggctgagaattgaaaatgtgaaaataatgcagccccagtgtaaaaaaaaatccagatttttcaattgccattctgcgagtaaaacctaggaattaacctgtggcctttttgttttattgtttcataaatgagtaatagctagagggaggtatcccttagaccatttcaggcccaattgctacagagaagaaaatgatactatgaagtcacataaggatgacacattttagaagtcttaagatgtgactcttttttttttttttaaacacgctgggcatgtgagctaccttctggatggtatcttggtccaagtttccagaactactgccctttggtgcctgagtctcaatgatggggagaacagggcactataaattcagaggctctggatttagaattttcttggaacaattcggtatacctgttatttgtgaatgcatttcacatcatttggatattgtcagaacattactgacctaagggtatcagaatcaaagctcttgattttcttcagcccagaatgcctcaccagcaagatgatcttctttccgttctcttacaatatccccttcagtcatccagcccattgcctcctcacacctttaagtgaaaacaggtctgatttccaatgacaatctgtgaaggaagcctacagagaacgcagcttgctgcacccagcatgaagactagcacagcactcacacctcgctcagcacccaggatttgcacaggtgttcaggaagcattgaatgaatgaaaaatcatgaatagaggaaatctgcccacttagttatttctggagtgatcctggtatctcttccaagttttcttgttataaaaataatcttacttgtggtttgcagaagttctccaatgtcctctggacccctgattttctcattcttaagactcaatggttgtctctgttgggcacctctgacctacgtttgtggtttaacatatatttattgagtgccttctctgggccaaacctttgtgaacaaggtagaaaactcccgtacttttgaagcttatattctaatgctacagatgggcaaaaacaaataaatactcttatttcaggtaataagtccaggaagaaaaacaaaacagaataagggaatggaaaagaaaggggtggggtgaggttactttaattatgatgatagaggcaagtctctctgaggaagtaacatttaagcagagactaaatagaacagtttagggatgttcttaactacatgcagggatgtagttagaattaaaatatgtgtagccagttttcccagcaccatttattaaatagggaatcctttccccattgcttgtttttgtcaggtttgtcaaagatcagatagttgtagatatgtggcattatttctgatggctctgttctgttccattggtctatatctctgttttggtaccagtaccatgctgttttggttactgtagccttgtagtatagtttgaagtcaggtagcgtgatgcctccagctttgttcttttggcttcggattgacttggcaatgcgggctcttttttggttccatatgaactttaaagtagttttttccaattctgtgaagaaaggcattggtagcttgatggggatggcattgaatctataaattaccttgggcagtatggccattttcacaatattgattcttcctatccatgagcatggaatgttcttccctttgtttgtaccctcttttacttcgttgagcagtggtttgtagttctccttgaagaggtccttcacatcccttgtaagctggattcctaggtattttattctctttgaagaattgtgaatgggagttcactcatgatttggctgtttgtctgttattggtgtataagaatgcttgtgatttttgcacattgattttgtatcccgagactttgctgaagttgcctatcagcttaaggagattttgggctgagatgatgggttttctagccatatgtagaaagctgaaactggatcccttccttacaccttatacaaaaattaattctagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaatctatccatctgacaatgggctgatatccagaatctacaaagaactcaaacaaatttacaggaaaaaaaaaaccccatcaacaagtgggcaaagtatatgaacagacacttctcaaaagaagacatttatgcagccaaaagacacatgaaaagacactcatcatcactggccatcagagaaatgcaaatcaaaaccacaacgagataccatctcacaccagttagaatggcaatcattaaaaagtcaggaaacaacaggtgctggagaggacgtggagaaataggaacactttcacactgttggtgggactgtaaactagttcaaccattgtggaagtcagtgtggcgattcctcagggatctagaactagaaataccatttgacccagccatcccattactgggtatatacccaaaggattataaatcatgctgctgtaaagacacatgcacatgtatgtttattgcggcactattcacgacagcaaagacttggaaccaacccaaatgtccaacaatgataagactagattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcattcataggtgggaattgaacaatgagaacacatggacacaggaaggggaacatcacacactagggcctgttgtggggtggggggaagggggaggatagcattaggagatatacctaatgtaaatgacgagttaatgagtgcagcacaacaacatggcacatgtatacatatgtaacaaacctgtacgttgtgcacatgtaccccaaaacttaaagtataaaaaaaaagaattaaaatatgtgataacagtaacgcaaacagtgggagagatttaagtgaaattaaaatattctgagattcttagtacatgctgtctggaaaatggtaaaagtactcatttatattgggcttttgtaagttaagcatgcattatatgttctctacaattttaataacggaataataaaatagggatgggaaacaaaatataataataatacttgattaatccaaagagtagcaaaaaaaggagagaaaaataatatagtctcagtaagagaaaacagatgatggatttaaaccccaaatatacccaaaattacatcaaatgcaaattgattaaatctaattaactgattataaacaaaacagtgcaatcagtacccaatcacctgcagcttacaagagatacattttgaatataagagcttgaaaatgttgcaaggatagaaaattctagataaacattaaccaaaagaagtctggtttagcaatactgaaattagacaaagtagactttaaagccataagaatttctagaaatcaagaccaggccaggcatgatgcatcatgcctgtaatgccagcactttgagaggctgaagtggggagatcacttgaggccaggagttcaagactagcctgggcaacatagtgagaccctcgtctctaaaaataaaagtaaaaataaaaataaaactagccaagtgtggtcgtgtgcacctgtaatcttagctactcagcaggctgaggcaggaggatcccttgagaccaggagtttaaaattatagtaagctatgatcatgccactgtacttcagcctgggtgaaagagtaagaccctgtcttaaaagaaataatcttataccatgcaagagttaacccatcatgatgatgtaataattctcaatttataatgtctaataacatagcttcaaaaaagacaaagcaaaaattaactgaactaaatgggaaacagacaaatctgcaaatatagtgggaaattttaatacacttctgccaggaattgatagagcaagcaaaagaaatcagtattgaacaaataatatttgaagaacatgatggacaaggacatctgctaccttttcctctttgcagcactgcactaagaactttgccagacacatctaggcccatttgcggggacaggggcatgaagacagatagaggtccacattctacatatctgaatgtgttaatttaataaatttaagaagctaagaaaactgtcaaaatatattttcttctccttccttgacaaatatatcttcatggtaacaaaataaaattatgattattgtttatatatgactgaaaattagcaaaatgtcaaagattattatatttaattattatgaaacatgcatgggtgttctgttgatggccatgtgtgaatgatggtgtcataaaacaaaggcatgaataacccaccactattacatatttattttacaaagtatttcccatgcctttattttagcaaatttatctcgttacaataagatatccatataatcggtacactactaacagtaatgatttaaaaggttaaaaaataaaatgcaattgcattcaaggtgtatacattttgatatatttttataaaaaataagaaacatctagaatatcaaaaaattattttttcaggtttaaaaatgctgtttttctaaaatattcaacattatacgttaaaattaaaggcaagatgcaaataaattactgagtttcaaaattttaaatcaatattaagaaaatatgacatttaaaatttggttttaaaaaatttaatgaattttattaaatatttttataaaaatgaaactttttcagttctaacatggaatgtccttctatatgccaatgaaaagaatcaccatgaagcttcacaaatgttaggtctggaagtaaatatatgaaaatttaagaataacataaattgtttcatactgcaaaatattgctcagatggcatacacaattactcaaaaaatgttgctaatttacgaataacttgctgatcttcaaaattaaaaatcagaatgcaagatgagtgaggaaaaaaagctcagacctactgggagtcaatactatacttcattatgcaaggaatctatgtagtcatgctatctaggaggataaatttgtcaagttaatttgtcttttaccttagtgcttctgtcactacagtcttctttcatggaaaagcagtgtttgtccccactatcaacataagcacaacttataaactttcatggcatctggatgttgttacattttgtttcaaaactgtagggcaagagatatggagaaatgtttttctggagtgggggctggatgatgttagggtaaaagtggacatttagggtaacagatcccgagagagagagaacgcatgcattctttaataaatgtattgtggtcagtgggtggatttgtgatatgttggtctaaaagtggtatcagttttaaccaaaacaataaagcaaaaaagaaaaagaaatgaaaggattagaaaggcagaaataaagctgtcataatattcagaaaatatggctgtatatatagaaaagtatcattattattttcaaataaactatttgaattaataactaaattctatagaatttcatcatgtgaatatactacaatttatttattcattctaccattgatgtacaattaggttgtttccaactcttggctattacaaacaaattctcagtaaatcaattatatttccatatacaagccaaaaacagaagatgaaaaaattaaaaaatattttatttaaaataacataaaaatcatatatctagccaggcgtggtggctcatgcctgtgatcccagcactttgggaggctgaggcgggcagatcaagaggtcaggagttccagaccagcctggccaatatggtgaaatcccacctctactaataatacaaaaattagccaggcatggtggtgcgcaccggtagtcccagctactcatgaggctgaggcagaagaatcacttgaaccaagaaggtggaggttgcagtgagccgagatcgtgccactgcactccatccggggtgacagagtgagactctgttccctccccaaaaaatcatttatctaggaataaatctaatcaaaaatgtgcatgactgctacaaaaaactacattatttacagaaaacaaagaagtctaaatcaatggaaatatacaaaatgcttatgaacagagattctatattgtaaataagtcatttctactcattaaattatagttgaatgcaattctactcaaaattctatcaggtaatttgaaagttgacaagctaatttaaaatttatttgaaaatttaaaaggccaaaaagaatcaagaaagttctgaagaagaacagaactcagtaatgtataccatcagatatctcaatctttattacaattaaaataagatggtattagcagaaggacatacaaacagagaaaccagaaacaaactcatacttataccatcacctgatttatgacaaaggtgaaactgcagtgcagtgaggaaataataatcttttcaataaatagtagatcacttggatattgatatgcgggaagaaaagaatttcacccctatcttacgtcataaacaaaggtcaattgtaggtggattataaagctaaatgtaaaaggttaataattttaaaaaagcttctataacacaggtgaatatctttatgacattggggtagacaaaaatttcttaaacaagactaaataagcattaactatacagaaaaagtctgataaattggactacgttaaaactaagaactttatattaacaaagtcaccattaagagaaagaaaaggcaagttagactgggagaagatatctgcagtgtttatgtccaatataatatctatatccagaatatataaagaactcctacaaatcaattacagaatatattcaaagagccaattaagcatcagaaaatgtgctcatcaagggcaggcaactcaaagtgacaatggggtaccatgacacgctgaccagaccggtcaaaatgaaaaatacagacaatgccaagtgatggcaaggatatagagcaattagaactggtgaaggtaaaatagtacaaccactttgaaaaattcttaggcagtatttaataaagttgaatatatacgtatcctaagacccagcaattccattcatggtatgtacccaacagaaatgcatacaagtgtgtaccaaaagacatgtataacaatgttcatagtagcattatttgtaatagtcaagagctggaaataagccaattgtacatcaatggtagaatggatgaataaattgtagtgtattcttacaatgaaatactatagagcaataaaaataaaactatggctatatgcaacaacatgaataaatcttaccaacaacgttagataaatgaagtcaaaccccaaaatgcacatattctatgaatccacatatgcaaagttcacaataggtgacagtggctactcctttgggaagcagtgaggaaagaactaagagagtactacagagggggctctgggtgtctgtaatttctatttcccaatccaggtggggtttacatgaacatgttactttgtgaaaattcattgagctgtaactaaacatctggaattatttatgaatgaaattatatataactcaatgggaagctgggaggatagggaggaggtatgggggctaaagaaaacatggagtggccaaatgcttacaattgttattgctgggttacggatacctgggtgtttgtttcactattctttccattttgtgtatatttgaaattttccattataaaaaggaccaaaaaaaaaaaaagagagagagaaaactattcacagagacccacaacagcctcatcatggtttttactggcctctctcactgaaccattgaatcacagttttattggctttatctgaaggtaaacatacactgtggaaatggaatgtcatttgagggcaagcattaagatgttgctatcctctgtatgtccttcctggcacctagaatgctgtctcacccttcctgggcacttaaaggtttggtttctgctgctgccatcagctaatcttgcctgaaaaattgtgtgctattgattccgctcttgcctcttgactccaaacccactcttgtattttcaggctttgtgacacttgagaggatattttgcaaaccacgctcctgatttgccagttggctttccggttctgccaaaaaggggagctagagggaagtgggaagcctgtaggaaaaagaaggaagaggtttgcttcttcctttttacttcctgtgcacttcctgtttcctgattttttgggattcgtcccagaggttgcattgccttctcttcacagcaggtgaattcaatggcgcagtttttccaacactcacataacagcctcaacactctctgctccaagtaccagctgagcagctccctcctcaagtttccatgttttaataattctagccttttctctttgaccctccaggcctaggagtggcagctgcttcctgcaattctacctccctgggacctgaaagttgttttacactttagataattaacaactttctacctagttaacaattcatgttaagcatgctctgttgaagatgtgagttctgcctccagaatgggtcttgactgacacaacctccaagagttatatactctgtccttgctgcctgtgtgatgacatacaatttgttgattattttctcttattgagcatacatttgtgtaaaaaatcaacagcttttgcttcttatccccaccccatgtaagcagaacagcaatttcaattatttgaaaattcagctatctcaatttatattttaaaatatgactattgaaaattaaataattgagttttgctttaataataatgtagttagtatagtatgcaatgggacaatttttgacaaagtatatctgagcataagccacacatctctcacaggttcacactatttcttttaaagctctccattgtgaatgaaactgatacagcaatatttgaaattcagaggccaaaaagccaaattctatctcagaagcaattgccataaaagtgttgatgtcataagcatatgaaagccacaaggtagctgcttaattgaaaagcagatgagaggaaagctgcattttacatgaataaatactgccacaaacaaagagcaccctgttaagaatttaggcaaaatgtgctgtggaaagatggacaggtattatcctaaggaaataatacagtaaatgacaatgaattcatctggattagactatttcatattagcagtctgttctcagttgcccatcctttcagaaggtgtgaagaccagaaataagaccctcaatagtagatacagaaattatcttcttaaactgatagataatgccctaagttaggaacttcaggagagaaaagcctatgtttaaattttcctgagatcatgaggttcacattcaatgaatcccccatacctgttcttaaatttttttttaagtataggaaggttggaacctttccttagtttaagtgtataataagtggcaaaagagggattagaccctggtcttctgattcagggcctggccctcctttcatgaaggttctctagttagcattagaacatgccttcttcaggaacaaggccaactaaaaagcaacctgtgaaagaaatcaatgaactatcccctacctccacatacatacacctgtcctcaggaatgtctctcacaggacatctggatcaactggactctaatgggccacaaacatacctctaatgttgagaaactgtcactacctttggaatggctgaatgcttcatggaaccatcttgttttgtttggagggaaacaatggagactatttaccagcagatagagatcccagagggaaatgggaatttccaattaaaagtagaggatccttatgttactgtttcgatgacgggcttaggaaaatttaagtgtctctgatatttccctaagtctgaaaaaactgttattttgaaaaatggaggaattgtgtgcttaacaactatcttacaagacaacagcttgtaaaaattaaaaagtaaaaattggttccactgtctgcatcacatcagcattagaagactgagctaagaaagtagttacggctgagttggacaactacagctgaggttatgtcatagggttagtcagtttatcacttctattcatagtgaacttgatcatacactgatgtgtaatccaccttataaattatagagaattttaattagctgctttttaaggaaacagtatttgaaatacagctagcaccaattttctgcaattcttaaagcaaagataatttaccgtactataagcttaaatttgaagaatgaatgttctttcagtggcatttctgaaactttgctattgacctaggttaggggacagaatgggtgtgctgtcggggctgggcagaggagtgtagcccagagcagttactgcgcagtacaatttatttgaagctggtgttatattcaaaaagagagaaagattttgcattctataatatgttcttgttcacataacataaaatattctgaattacttgctaagtaaattatttaactgctgccctcctttaaaatatctaccaataaaattaagctcaggtcctagggttctgtttatcctgaggcacactactgcctctcccaattcaaaaagcatggacatttagacgcaattcttggcactatagatactctacagaaggatggatcaacagtataaatggacgggtacctggttttggtgggggtgcaggtaaggaggatactttctcactttattagcccatgtataaactgtggggttatgtttatttgattgcttagtggcttaaaatgaaaaatagctttgtgcccttaagagaccaaaacccagtcctgatcatcaccgcaaccactcacgctgcacaacattgttagaggggaccccccacagtatacctcacctcatatgggctggcagagctgctctgtgatgttacaatacatcaatgacaccaaactttctcttattttccctaggacctatgccctcctctcttaggttcagaagagggtcttgtccatattactgagaggataaagatcatcatctttaattcaaaatactgcttccttgacttctatgttttctattttctccctcaccatatctagggatggatgttcccatttcttcttcaagccacctctcgcactgtgtgcttgatcccatctccttcttcctctttctggtccttgctcatgttatgatcacaacactccagcatcttcagttcttctctatcctcacactgggagtttgtatgtttaccttgttagattttatggttgcagactcctatgctcgtagaggactggtgagtcatcaaagaagggaaggaccagacaggggttgtttaacccaaagcatatgccccaaggaaaggggacagccgctacttggctccaactgatgttgtcacatggaaaggaagaccccaagttgtatgattttccaaaagtagatgggaatctggatttacatatgaaatctggtaagttttaaatgttgactacaatttaaaaaattgaacactgtggcttgtttcactgtggatgaaacaaatacttcattagccccaactataagtttcacctatccatctaaacattcattttactctgcttcccattcaaataccttgttacttcactcataaacttcccaaacatctaagcctgtaactattggcttcttttccacatccacggttctctccttatccaacttcaatatgtttcccactcttctgaaagtgtattcttgaaggtcactaggaagtttctaactagttgatatggtctggacatttgtcatccaaatctcctgttgaaatgtgacctagcatgttggaggggatcctagtgggaggtgctggatcacagggacagatctcttatgaatggcttagtgccatccctttggtattgagtgagttcttgcactgagttcatgtgagatctggtcatttaagattgtggcacctgctccacccctcttgctctgatgcacctgctcccttagccttctgccatggttgaaagattcctgaggcccttcccagaagcagatgactgtgccatacttcttgtacagcttgcagaaccatgagccaattaaacctcttttctttgtaaattacccagcctcgggtattccttcatgcaatgcaaatagactaacacaccactgaatactctggaatacttgtgtgtatgtacatatctccatacatccttaaaacaatagtttcaaggagtgattccaagagaagtaatatcagcattgtctgggggacctgctagaactgcagaatttcatgcctcttccaagacctaataaatcagaaactctgggggtagattcagcaatctatgcgttgataagcatccaaggcgattgtgatggctgcaagtttcagaaccactgccttaaaatatacctacctgtgagtgtacctgttgccagagagcaattaatctatccctctgaattttgccccacagcttcaattccttttctacatgctgggaaagacctgcattgatataacactttttattaaatgttttttcatattttattacctaactcctataaataagaactttacacaataggcaaagcaagtcaaaaaagtttattatgcccatctaaccatcatatgtaaatgtaaaagcagcaataagagattaagtgactttcttaaaatcatagttaggaaagtgtcagagttaatatcaatctagtttcctgacatatcatagccctttctttctgtgttttagaaatactatttttttctacttgtaagagtctaatacattagttgaagaaatgctggaaaatacagaaaagactacagaagaaagtaaaaaatcatccagaattctaccactgacatcatgcatttccctcctccaatctgtttttttttctctctttttttttttaaatgcacaagtgcatgtgagtgcagatgcaatcctctttcaattacaggacacaacactgtcaggaggtaagcggctctcttgttctcagtgcctacgacaactttccgatgggaccataaataagaaatttaaataattattttatttatcttttgttcatcagagctctacgtaactccaaaagcagatgcaaaatctaagtgaaatgaaatcagcattgctgacttttattatagccatgacatacaggaaaaattgctaatcccttatgaaaatattcaatatctctatgctcttaggggtgcctgaggcaactcctagtgcagatagcatgtggagtctcatggtgactaactgtaattgaattcaataaaaaactccattatcataatagtctagggtgtcaataaaattgatacttctataataggaaaaatataaaatatacccaagggcatacaatgggaagcttttaattattattattgatccagagaattatttttccctgattctggcattactctgaaatccagtatttctgtcctcacttgtttatctccctttaaaaagctaaggtcaaaaagtctaaagaaaattcatgggcaggccaaactaagtgctatttctgacaaataacatttatttggtgcttatttttagtcacacttatcttgttgatttatgagacagctagcaagaacctttgcaaaagtgttttgagttccttttgggggttcttataggagtccctaacctgctagatctgtatttcagaatgtaattccaacaatgaaatcaacaattttatttcagagcaatacaaaggaaaaaagccaactaacaagaacaatcccagttgttgagtgtctactgtgggccagtactatgctggtactctccaaatcattagagtataacctctttttaaaattacaaaatattttaaacactcaaaatggcatacagaatgatataataaccaacaatcaatctactacctgatttattcaaattttaatatttttaatattcacacttacttgaaagaagtaaaatactccagatacatgtcaagccctctgtgttccctcttcattccacttctctctctccctttcctcaccatcctgagtttgatatctatcattcccatgtactttttatgcctatactttctctctctcccattatatacatatacaggtatgtgtacgtgtttaaaacatttctataataggtttcataaaatacacacacaatttgcttgtttttgctgtgttacattatgcaagtccttatacatatacttaatctctttaggcctcaatctcttcatctgtaaaagagggataataatcctacatagaagaggactaactaatactgataaagtgctcagcacagtggctagcatgtaatcagcatttaatagaagttagtcatatacatattattatctgacatatcactttgcctttcaagagattagccaaaggaaattcttcttgtcttacctggaaattaacttttactatgagtgtcttctctaactcatatatttctacctgctccatgtgacacaggacagatcaaatgcaaatgtgtcaccatagactgcttgaacacacttgtgatggcacagacatgtacatacacacaccacacacacgaaggctaaccatgtgacaggaagtgactggagctgctctgggtcaatccatttcacccacacatatcagtgaggtgttttgattattttcattttatatatgaggaaactgaggcacaaagaggttaataaactgccagagatcacaaagttagcaaatactatcatggcaagatgctctatgcaagcagtcctgctcctgagtgtgtgctaagggctgacactcagttgcctcttgactcttagcctatacagattttcctatttgctggttctgcaaaattcgtaagttcactaaagagatatgcaatagtgaatatcatgtgtgttcccaggttatttattgaattatttaccaaaagcaaatatccaaagccatttgttctgggcaggggctcacactcagctcagctgaagcagatataaagatactatgcaggagagcagatctgtgatttcagttgcctgagtactcctattaatacaagaaaaaattcccattgcactcatgcaagccagcaggcacattttcctctttaccatgagacttgtttctttatactcaacaagatgacaaaacattaatcccttccctctgaaaagtataacacaagaagttttagactggcctccattgatgtagtggggtaagtggtggaagaaattgttgagtcaccattgtgagcacgtttaatgaaagatctgtgagtcacagctgggcagtaagattgtgcagaatgaatgcctgcacaatcttaggtgggttaatgttaaaattatgatcgttgtggtttaacctgataataaatttccagcaatattggtcagtcccttcatctaggcagcctaggcccagatgtttttattgtcccttttttgatttttttgtttgtttgtttgtttgttggttggttggttttaacaacacagctaaagacatcctcctggcttcctgatagcactggcctcaccagaagtgataaagcattcctagaaacggaaggaaggatgaatcacaaagtacagttcagccacagaggagggtgataagcaacccttctttgtttcaaatggagacagctcaggaggaagttggtttgtgttaaattagaaacaacaagagcctcctcctatctggaacaggttgctgtaccagattgtgtaagttccttctctctagagaccttgaagtacaggataagacacatttgatcagcacaaccagcttccagagttatttccagatgccatcataagcccctgaggttctcatgaatcagcaaaattgctttgggcattctagataccgacccaagttacctctcttttttgctctcagctcaggttgcttaggtgagaaaggttaaaatagacaacaaaaagatacacaatccatatctcttgaatcctcagcaaaacacaggcattcaattcttttaaaatgagataaaagaacagcatacatttcatttattttggcttgtcttcctgttagaatactattaaaccaaccagaatcttttttgaccatatttttatatttggttggatgtccattttttaaaaaggtatttgtgtgtatgttcaaaggataaaacaaagaccaccagagattaaaaagaaaacaagacaaaactgagtttattgcctgtgggataagggagaaccagagctcagccacatcatccaagaaatgagtttagctggtctcttcctgtgctaaagacaaaagggactgcttatttcttactagaagagattctaggcattataagaaatgttcaacgtagattaaatttaggggtagccatatttagcaaataaaaattcaagatgctcagctaaatttgcattgcagataaacaatgaatcatttttagtatgtcccaaatattgcatgggataaacttacgctaaaaaatgactccttgtataatgaaaaacgaaacttacctagcatctcatattttatctggcaactcgaattagtgggactcagtggggtttggggtcatgcagcagcagctagtccatatgctcacaactgggacttgctaacatttttctttaacagtgtaaagtaaatgtcacactgcagtgcattctgctaaagggaccataaaccaaattctcccacctgggatcacccgttgtgatcaagtccagaggaatataccaagttggagagcaaagcacatgcctgctagaccctccaggaactcaagccaaggtcagaggaactgcagttgcccatgcttcccagaccaggagaatcagttgctggacactgccggagtacattagtgtcagaaggtggttcaaagaagtctttgaagacaacttcagtttttagcttgtaaagctgactggaagataatgttttaactgaggtccagaatacaggaagattcactgggaataccagaaaggcccaggggccactgcaatctctttctgtcctccccagttgcctaatgaacacttctatttaagcatcctctgcttggatatcctacagttcttaaactcaacatgctcaacactcaattcaccctcttcctctccaaacccatttgtcctcccataattcccaactcaactacagatagcatgcgaagactctaacagccccaggctagaagtctccaagtcatctccaaatgccactgccccctcatactgcaactaatcaaatgccaattccttttgatactatgtctcctttagttcaagtcatcattgtctctgatctcaacaacagcaaaagggtctgaactgagctctgcccccgtccagccattttcccttttggtgtactcttttcatcgatatctttataaaatgcaattttgagaatgtttctctatttctaaagtacctcagcagcttttcatgcctagaggataaaatccaaatgccttcggggagacacaaaggtccttcaaggtctggctttggtctgtttccagcttctcgaccatcactttcccccaacaacagatggtgccaagctaccggccaggtgtctgccatctgatgctcttccacatcaagatgactttgcacagacagttcctgtacctggaatgtcctctgcctactctgcttttgtctggcaaactcactgaagaccctgctctagtgttagaccggcttctggtaagccggcttccttctcgactgaagatttagctgcacccctagtttgtatacccacagcattctgtgcctgccttcactatggggcttactgttttatgctgactgtgttcggtaacatgtttgtcttcctcgtaggattatgaacctgggggagggaatatgccttatttgctttgaacccctatgacttcacttagcgctgacggtaataattatagcagtaaaagttattgtagccaacactatgtgctggacatttttctgggggctctttatccatcttaacttgttaatcctcacaacaaccctaggaggccagagctactatcatgtccatatgacagagaaagaaagcaaggcagagatgtgaaaggcggccaaagtactatatagttagtaaaccggtggtttccaaatcacctacaaagtagaagcacctgagaatattttttcaaaatttaaaagtcttgagtgggttccagcccactggagaaccactgaagctgaatttttggtgggctgggacctggaggatcctattaaactttcccaggtgattttactgtgcagccagccttgagaaccactgatctcaagttcctaagaaacttcagccaatgctggggagaaaggagagaaaccaaatcattttttggggaaaaaagggatgcagacatggggagtagagagttccatagctctgcagccatggccccaagtgtcccaccaagcatgagacttgtaggtgagcagagtaccaggctcacctgatatgccaatctgcccttcctgaacattacggataggaccatggctctttctttagcaaatatgtgtctggaggatcagacgtaggaagggtggtggagctggctcctttctaacttggcagtgcactttaccaagagatagaagaagacttggctgaattaggcatttctgagcacaggcattataattctgcctaatcttcaaagacagaatgaacttgtcctgctcctttctatgtaccagctgcttctctgcaaagaaatcattcattccttccctcaaattagaatgtacaatgtggtagccactttccacgtagtcaaaaggttgtcaaatggcagaattagacctgaaaatgttcatttgatgagtgcttgcgacacgtttgcttatgtgtcatcagcgctagatgctttccagggaagaaataagaacggaaactagagagaagaggtgcagaaagaatgaggacttgatccaggatggagctaggtagaacagggatttttcttggtagatagaaatatacagtaactcaccctaggaaagggtgagttactgcagatctcatcagcagtggtcaaacatggggcaacaatgtgggcttatgaggtgatggacagatcaattccgactcgaacaccaaggggttatggcagaatctgaatgagaaaaaatgaagattccctatgactggagaaaagaggctgtgtcttcaagggttaagtctgtcaaagcgatcatcatggcagataaggatgccatttaacacagaccatgcagtcacgcaatcctggggagctggaccctggcccagccccttgggagcgccatcacacttggaaaactccttaaactcaccgagcctcagtttcctcctatataaatagacttaataaaaaacctaactcatatggttgtggggaggaagaaataaagagtctgcattaacaataacagctaacactgagagaaagagagagagagagggagaatgaatctatgtgtactcaattcattatatcctcacaacaatcttagacactaggtactattcccatgcccatactacagatgaggaaactcaggaacagagaaattgagtgacttccccaaagtggtatagataataagtggccaagccagattctgacccaaggcaatctagcaccacctgcaatactaggctcctactgcaaaactatgctcaaaattctctatatggattagcagacaaaatgaggacaaatagcagatgcaagaaaaatgcaagggccagaatctctaaggatttcaaaggaggtccctgatccctcaggtgccaggagtaagatttagacctagatccacattttatcatattccgtccttttctttgcatactctagctggatgggccttgaatgaggacacaaaaggcaccgtttgaagtccccagaccactgctggctcctccaactcagcaggcagggaggacaggagcctgcagcagaatcatttctcatctaaccacctctctcaaccagtgctccaccaggcagcacatctgatttctcagattcctcagtcccagcatttgtgaaactggattttatctgtgttgacaatcaataaagcttttaagaatagagacagctcttgttctggagagttctaagtgctggtgagcagatctaagaatgcagaaaaatattaatgaccctcaactattaacattcccaaatagtttgttcattttcatacagttgggtgcttattagtcagactggcacaaaactaatctttatttttaaaccaccatcttcctttagtgttgcattcatttctattttttaagaaatgaattaaatttcattactgtgagcagtagtatctgaatctccaagtttcatgtacccttaggcacttccttgctttaatattttcttattttttccaccaagcacactgttggcctacttggccacctctttagaataagttatattcctttaaaactaccatcccaccaaaggtatgtactagtgagaaaagcaagccaaggaccagatgggcatcctgtgtcacctggatatgtatcggacagggagagcacagcagttccttcagatttctctctgtcacataaagtggcaggggatgagacccacaagcactttctggctccaaaaattggcatctggcagcatctccttccacctgcatcaaactccaagcttcttttagagaaccaagcagtatttttagcagcaaaggtatgaaaatgactgattacatatttgaacatggatacaaaaaagcacacttaaaaaaaattttaaaaactcctatcctttccacaacattaacaatttaaactacactatgaaggtaaaaaagcttactactcagctttcaccaaggtaagccactgaatgaattcctcagagattctgtcaaaggagccacatcctcagtggcagggtagaagaaaggatccgcctgcagccacaggccctgccccactcattgcctccccaggactacagtccactcttctaagagccagtctcttcctgaagccacccgtctatcctccttccccaaggcatgaagagcgtaggacttggagcatgacaatctcatgacagcctggccagccctatttctcactgtgtgaacttaagcacttcaactgaacctttgagccttgaattcttcaatgacagcgggactggtgcccagtgtctattccactttccttctagcatgccttcctgatctgcagaggcttggaaatctgacagtacagatgcccttgcagctgggtgcagggtttatttaggttcagccaatcagacactctcaagctggatttagaaggtgaaagtcaggttagaggctgtgtttctgctctttctcctggaaatcatgggaggattttttttttttttttaataacctgtggtgttttgtaactaggatcctaagcactgaatggcagggccctggtggtggtatgtgccaaaatgcaactccaagcttcttttagagaaccaaaactgtgccaaaatgcacagttccagtggcagcatcccgattcctctcctgctcgacaggcagaagcagctctcttcaggcagaccagttttacagtgaggtccgagacatagcacactgagacctagcctgctccacaggcctttcaatgattttataagcatccaattcctacattaaaacctgatctctctttaaaataataagatggtttctattttctgcaaccgagcctagactgatatacctctctaaccttctgagcaggtataaagactgaaagatgaaaggcaggcaagagagcacagcagttaagaacataagctctgagctcagatggcctgggcttaaatcctggtcccgcctctagcttgatttgcaaccaggggcaagttccttaatctccagtttttacatgatggggatactacaggattacataagataatacatgtagaatccttgccaagtacttggtccctagtaggaattcaatacatgttagttttttcttgtcctaagttctcataggaccctctgtacacttctattattgcagttatcccattgatcaattctctgtgagcacaaacccagaggactgtttatcacatataagtaaaaagtagaacaccccaaattctaatccacgtgacttgggagcaaccttgaagaactgaaaaaaataattgaaacttattaagtgaaaacataattgtatctaccgtactgtgttacggaaatagtgtgaaacaggtggccgggtgtggaagtatgacaaagaggggaaattacagcaagagttggccaggcctgtccaacggtgctgaaggatagaggaaatcttggctgggcaaatgctccattttcctcagtaaggtcatccctgctgtgggtcagagtctatcaagctattttagcaaagcaacacttcttaagtccactacgatgccataatctggctccttagtttgttatctgtagacagccaacgtgctagtcagaacagtcaacttcacagtttaattcctaatcgtaaattaatagattgtcacctggttattataattttactcacctacagtcagatacggcactgattttacctttccatttggttttagcgatgtagctctcattgtattacaatgggctgtaattggatttgtattaatatatagcagtcataatgagcttggttcacataagtccacctaggagagacaatccctttgcagtgagctatcatgatcaggtttatgattccactgggctgagggccaggttcctgaccatggcaaattcaccaagttacctgctacctgctaactgctttgagtgccctgtgtgtccagcaataaccttcaaatttgagcactgaaactgtatacaatgatctgctttcatgtctgtgaaatgaccattcctaaatcagattttacctccaaatgcccagccaggcacatacatagttgatatataataaatatttgatgaatgaatccataaacaaatggatgtgcccttctgcagaggagttttaaaaaaactatagaaatggcaagaaagaaaataaatccaaagggactctgagaagaagagaatcataggcttaaatattttgtggtgattctttgcaaatattcaaagcttagctattgatattctaacatttttggacagctttttatataatgctgttatcatgagtgtattaattttctattgctgctctaacacattaccacaaaatttgatgctgacaacaatatttatatattatcctacagtttctgttgtcagaagtccaggcccagcatggcccagctgggttctctgcttgggcagtcatgtaattatgtgacaactaattcacctttgagaagcactactgattatcctaaagttccagattattctggagctaaaaaccagattttgtctggctccatttcagaccaggctctttgaaagaaactttgacttaagtctgttcacttcaatcggaaaaagatgatgtttctctagtctttctctagcaaatgctcaagtttagggaagtgttttagggagagaaaacgtgacatcagaaatgtataaaactagagcttgatattcacacttcttttactgaagctttttttttttttttttttttttagagacaatggtctgactctgttgcccaggctgcagtaagtggcaccatcattactcactgtagcctcaaactcctgggctcaggcaatcttcctgactcagcctccaaaagcattagggttacaggtgggaggcattgtgcccagcctgaaactttttaaaaacagaaatgcctacctcaaaattctggagtcaattcattcaatttaccaactcacaattgaaacaactgactaatcagatgataacaggttgtaaattccttgaaggcaagactgcgtttcatttgtctctgtaccccgagaactgagcatggggattgttgtgtatttaacatactgtatgtttaataaatttgagacctttggatgaaactaaacatggcagcaaaatacatggctgtataaaaacacttgtcagtagctgaaaaatttcactgattcataaagttagttgccaagaagaaaaaaaattgtaaagcagtttcttttgtttcttcttttctttctcctcctcctcctttgtcttgctttaaattatgttcacctaaaattctagaaggctatttttttctttgttagcaaatagatgcaaagcagaaatagtccaatgataattaaaaattagcttgaggtaagggccaggcccataactgaaataaagaaacatctaaaataccccaataagccagtggaatttcccagtcttttaaagtcacataaaacccagtagagatcttgaaaaagataaagacatactactatcatttatttgtcttcaccaaaattcacgttgaaatttgatcttcagtgtgtgctgaggatgttgggaggtggggtctagtgggaggtgtttgggtcatgggggatggatcccttatgaatggcttagtactatactcttggtagtgagttctccctctggcaagactgtattattactcttgagaatagattagttccctctagagtgggttgttacaaagccagaatgctccttgggtttctctctgcacatgtccacttccccttttaccttctttttcatgttagaaccctgtatgaaagccctccccagaagccagggccatgaccttgaaattcccagcctgtagaaccatgagctaaataaactttttttctttataaattatctagtctcaggtattatgttatagcaacacaaaacagactaagatacataccaacagagaaagtgaagagatttgatcactgcgtctatgctagaataatttttatataaaacaggaaaaactggtttatagaacattaaagaaaataacctacctaccaatagacatggagtcctgtgtctcctgtgacctaccaatagacatggagtccaggctttttgcctgaactaagtctgtgaagaagatagacacagggagtatccatcaaccccagtttcccatcccatcactctttgtttgtccacatgaataggacgtcagcccttctctggagcaggaaaggaggaacaaccataaataacctgtttgtgggatcagaaagttttctaattaggactattctacacaaattctgaactttccttatttattttcagtaggtctttacttaaacaaacaaaaaaaaccccctaagaattagaatataacattatttggaaaactctccttgctataaagcaacaagagatcaaggtttccttcttttgaaagaaccataggagtagtgtatatttgaaaggtttttgaacgggattggcttttgtaagtgtgagggtccaagacgaaagaagaaacttatcaggattggtttgtttttaataaaggaaggtaattccttttaaataatgctatattcagtaagaaagaaatcaagacagtcatttcacttcctgcttatcactgctgtcagtaattcctgctaatcagaaagttggagctagaacacattctcttgttctactaaggtaaagtcgtctgttctccttgattcaatagcttaccccataccgcaatgcaccttccttctgtttctgggatagactgcaaaaagtgcttgcctaactcttttgtgtcaagattgcacagcaatcagtatgcagcctattgatttatgtgaagactctcatcttgccaagcaaagagaaataaagtacaattagcttactttgtgatcctgctgtttacaaagaagatcaaacaaaagacacctacaaacagccacttagatctggaatacaaagcacgatgcttctatttagttcctgattcttaccatgtctgccatatggtagcaagttggcataacctaaataccagagaatcttgttttgaatttctacaaccatatctgggtttctcagtattggtgtccagcccatcaacagatggtgcccagcattttacccattaaacaccatgatctccataaccatttaataatgagattggaccagataagatcaaggaatagattaatattctgcacagattctgccagcttttcaactgcaaagtgaatttatggattgaatcctctgaaattatcccataaaagcagaacaatattctttagtcagttcacaaaacagtgtttggaggaaaatggcagcattgcagccatatggacacttgcacttgaatgataaaattggacaatgtaaaaacagattacttaaaattaattgctgtatctctttaagtaaagaatactctagttgactttggttttgacatcagtcatttactcaataattatttactgggtatctattatttgccaggcactcttttaggcattagggattcatgtgtgaataaaacagatttctgcctgaatgaaacttacagttcactgacttctttctatgtttccaccataaaccatatactggcataaatagggctcctgagaaagtgagtgaaccacccttgaggcccatcaaactccatataaacaccctgctatatccttttgttaaaaaataatgtggccttttaaaataagatagattaatgtttatcatcctgcttcctggcttctcaagcagtacagattttggtaattcaatctgagccacataactttattttgttgaatgttggtgtgatccacagatgattttcaatattcaccaaggaatttttcaatcaaattttggaaatctgttgcctcctattttattgagaaaatagaaacaaaaagacagcttctccaagtcccaccaagacattcacccattacctgtagctgggcaatcactcggctccctccttactattaaaatgtgggcacttgtcagggcctttccatttgtgtgcaggatcccccgcccattccccatccattcaaggacaacgcaccagtaattctccctctcttgaattatcaaatctttcctctgctgtgtaattcccattaccacacaaatgtactataaattttcttacttttatttttttattatactttaaattctgggatacatgtgcagaacgtgcaggtttgttacataggtatacatgtggcatggtggtttgctgcacccatcaacctgtcatctacattaggtatttctcctaatgctatccctccccttgtccctgacccccccaacaggctcctgtgtgatgttcccctccctatgcccatatgttctcattgttcaactcccacttatgaatgagaacatgtggtgtttggttttctgttctggtgttagtttgctgaaaatgatggtttccagcgtcatctatgtccctgcaaaggacattaagtcagtcttttttatggctgcatagtattccatggtgtatatgtgccaccttttttttaatccagcctaacattgatgggcatttgggttggttccaaatgtttgttctatcgcaaggacggaaaaccaaacaccacatgttctcactcataggtggaaattgaacaatgagaacacttggacacagggtggggaacatcacacaccagggcctgttgccgggtggggggagggtggagggttagcattaggagatacacctcacgtaaacgacaagttaaggagtgcatcacaccaacatggcacatgtatacgtatgtaacaaatctgcatgttgtgcacaggtacctttaacttaaagtataataaaaaaataaattaaatttaaaaaaatgtttgctattgtgaacagtgctgcagtaaacatgtgtgcatgtgtctttatagtagaatgatttataatccttagggtatgtacccagtaattagattgctgggtcaaatggtatttctggttctagatccttgaggaatcaccagactatcttctacaatggttgaactaatttacactcccaccaacagtgtaaaaacgttcctatttctcaacatcctctctagcatctgttgtttcctgactttttaatgatcaccattctaagtggcgtgagatggtatctcattgtggttttgatttgcatttctgtaatgaccagtgatgatgagctttttttcatatgtttgttggttgcataaatgtcattttttaatttttttattttattttattttattttattattatactttaagttttagggtacatgtgcacaacgtgcaggtttgttacgtatgtatacatgtgccatgttggtgtgctgcacccattaacttctcatttggcattaggtatatctcctaatgctgtccctcccccctttcccccatcccacaacagtcccatgtgtgatgctccccttcctatgtccacgtgttctcattgttcaattcccacctatgagtgaaaacatgcggtgtttggttttttgtccttgcgatagtttgctgagaatgatggtttccagcttcatccacgtccctacaaaggagatgaactcatcattttttatggctgcatagtattccgtggtgtatatgtgccacattttcttaatccagtctatcgttgttggacatttgggttggttccaagtctttgctgtcgtgaatagtgccgcaataaacatacgtgtgcatgtgtccttatagcagcatgattcataatcctttgggtatatacccagtaatgggatggctgggtcaaatggtatttctagttctagatccctgaggaatcgacacactgacttccacaatggttgaactagtttacagtcccaccaagagtgcaaaagtgtttgagaagtgtctgttcatatcctttgcccactttttgatggggttgtttttttcttgtaaatttgttgaagttccttgtagattctggatattagccctttgtcagattaatagatggcaaacattttctcccattttgtaggttgcctgttcacaccgatgatagtttcttttgctctgcagaagctctttaggttaattagatcccatttgtctattttagcttttgttgccattacttttggtgttttagtcatgaagtctttgcccatgcctatgtcctgaatggtattgcctaggttttcttctagggtttttatggttttaggtcttacgtttaagtctttaatccatcttgagttaatttttgtataaagtgtaaggaaggagtccagtttcagctttctgcatatggctagccagttttcccaacaccatttattaaatagggaattcttcccccattgcttgtttttgtcacatttgtcaaagatcagatggttgtagatgtgtggtgttatttctgaggcctctattctgttccattggtctatatatctgttttggtaccagtaccaagctgttttggttactgtggccttgtagtatagtttgaagtcaggtagcttgatgcctccagctttgttctttttgcttaggattgtcttggctatatgtgcttttttttttttttttttggttccatatgaaatttaaagttgttttttctaattctgtgaagaaagtcaatggtagcttgatgggaatagcattgaatctataaattactatgggcagtatggctgttttcatgatatcgattcttcctatccatgagcacggaatgtttttcccatttgtttgagtcctctcttatttccttgagcagtggtttatagttctccttgaggtggtccttcacatcccttgtaagttgtattcctaggtattttattctctttgtagcaactgtgaatgggagtttgctcatgatttggctgtttgtctattattggtgtataggaatgcttgtgatttttgcacattgattttgtatcctgagactttgctgaagttgtttatcagcttaaggagtttttgagctgagacaatggggttttctaaatatacaatcgtgtcatctgcaaacagagataatttgactttctcttttcctatttgaataccctttgtttctttctcttgcctaattgccctggccagaacttccaatactatgttgaatagcagtggtgagagagggcatcgttgtcttgtgccagttttcaaagggaatgcttccagcttttgtccattcagtatgatattggctgtgagtttgtcataaatagctcttattattttgagatatgttccatcaataccttgtttatggagtgaagcatgaaggggtgttgaattttatcaaaggcctttactgcatctgttgagataatcatgtagttttgtcactggttctgtttatgtgatggattatgtttattgatttgcatatgttgaaccagtcttgcatcccagggatgaagctgacttgatcatggtggataagctttttaatgtgctgctggattcggtttgccagcattttattgaggattttcatattgatgttcatcagggatattggcctgaaattttctttttttgttgtgtctctgccaggttttggtatcaggatgatgctggcctcatagaacgagttagggaggactttctctttttctattgtttggaatagtttcagaaggaatgataccagctcctctttgtacctctggtagaatttggctgtgaatccatctggtcccgggctttttttggttggcaggctattaattattgcctcaatttcagaacttgttattggtctactcagggattcgacttcttcctggtttagtcttgggaggatatatgtgtccaggaatttatccatgtcttctagattttctattttatttgcatagaggtgtttatagtattcttggatggtagtttgtatttctgtggcatcagtggtgatctctcctttatcattttttattgcgtctatttgattcttctctcttttcttctttattagtctggctagcagtctatctactttgttaatctttgcaaaaaaccagctcctggattcactgatttttttgaaggtttttttctgtctttatcttcttcagttctgctctgatcttacttctactggcttttgaatttgtttgctcttgcttctctagttcttttaactgtgatgttagagtgtcaattttggatctttcccactttctcctgtgggcatttagtgctgtgaatttccctctaaacactgcattagctgtgtcccagagattctggtacattgtgtctttgttctcattggtttcaaagaacttatttatttctgtcttaattttgttatttacgcagtagtcattcaggagcaagttattcaatttccatgtaattgtgtggttttgagtgagtttctttatcctgagttctattttgattgcactgtagtcagagagactgttatgatttccattctttagcatttgctgtggagtgttttacttccaattatgtggttgattttagaataagtgctatgtggtgcagagaagaatgtgtattctgttgatctggggtggagagttctgtagatgtctattaggtcctcttggtccatagctgagatcaagtcctgaatatctctgttaattttttgtctcattgatctaatattgacagtggggtgttaaagtctcccactattactgtgtgggagtctaaatctctttgtatgtctctaataacttgctttatgaatctgggtgctcctgtgttgggtgcatatatatttaggatagttagcttttcttgttgcattgatccctttaccattatgtaatgaccttctttgtcttttctgatatttgtttgtataaagtctgttttatcagagactaggattgcaactcctgcttttttttttgctttgcatttgcttagtaaatcttcctgcatccctttattttgagcctatgtatgtatttgcacattagatgggtctcctgaatacagaacaccaatgggtcttgactctttatccaatttgccagtctgtgccttttaattggggaatttagcccgtttacatttaaggttaatattgttatgtgtgaatctgatcctgccattatgatgctaactggttattttgcccattagttgatgcagtttcttcatagtgccgatggtctttacattttggtttgtttttgcagtggctggtacctgattttcctttccatatttagtgcttccttcaggagctcttgtaaggcaggcctggtggtgacaaaatccctcagcgtttgcttgtctgtaaaggattttatttctccttcatgtatgaggcttagtttggctggatatgaaattctgggttgataattcttttctttaagaatgttgaatattggcccccactctcttctggcttgtagggtttctgcagacagaactgctgttagtctgatggcttccctttgtggggaatccaacctttctctcgggctgaccttaacattttttccttcatttcaattttggtgaatctgacatttatgtgttttggggttgctcttctcgaggagtatctttgtggtgttctcagtatttcctgaatttgaatgttggcctgccttgctaggttggggaagttctcctggataatatcctgaagtgtgttttccaattggttccaatctccatgtcactttccggtataccaatcaaatgtaggtttgtttttttcacatagtcccatatttcttggaggctttgttcattccttttcattcttttttctctaatcttgtcttcatgctttatttcattaagttgatcttcaatctctgatatcctttcttccacttgaccagttcggctattgatacttgagtatgcttcacaaagttcttgtgctgtgtttttcagctcagtcaggtcatttatgttcttctctaaagtggttattctggttagcaattcctctaaccttttatcaaggttcttagcttccttgcattgggctagaatatgttcctttagcctggaggagtttgttattacccactttctgaagcttacttctgtcaattcgtcaaactcattctctgtccagttttgttcccttgctggtgaggagttgtgatcctttggaggagaagaggcattctggtttttggaatttttagcctacttgctctgttttttcctcatcttcagggatttatctacctttggtctttgctgttggtgaccttcagatggagtttttgcatggtcatcctttttattgatgttgatgctattgctttctgtttgttagttttcctcctaacagacaggcccctcttctgtaggtctgctggagtttgctgggggtccaatccagaacctgtttgcctgcaccagcagaggctgcagaacagcaaagattgatgcctgctccttctggaagcttcatcccagaggggcacctgccagatgccagccagagttctcctgtatgagttgtctgttgacccctgctgggagctgtctccccttcagaaggcatgagggtcagcgacccacttgaggaggcagtctgtcccttagcagagctcgagtgctgtgctgggagatctgctgctctcttcagagccggcaggcagggacgtttaagtctgctgaagctacgcccacagccaccccttcccccaggtgctctgccccagggagatgggagttttatctataagtccctgactgaggctgctacctttctttcagtgatgccctgcccagagaggagtaatatagagaggcagtctggctacagtgactttgcagtgctgtggtgggctccacccagttagaacttcccagtgactttgtttccactgtgagggaaaaaacgcctactgaagccttagtcacggcaggcacccctcccccgatcaagctcaagtgttccaggtcgacttcagactgctgtgctggtagcgagaatttcaagccagtggatcttagcttgctgggttccatgggtgtgggatctgcttagctagaccacttggctccctggcttcagcccccttttcaggggcatgaacggttttgtctcactggcattccaggcactactgggttaaaaacaaaaaacaaaaaacttctgcagctagctcagtgtctgcccaaatggccgtacaattttgtgcttgaaacccagggcccttgtggtataggcaactgagggaatctcctggtctgcgggttgtgaagaccatgggaaaagggtcgtatctgggccagatagcactgttcctcacagcacagtccctcatggcttcctttgggtaggggagggagttccccaaccccttgtgcttcccaggtaaggtgatgccccaccctgcttctgcttaccctctgtgggctgcatgcactgtctaaccagtcccagtgaggtgaaccgggtacctcagttggaaatacagaaatcacctgccttctgtgttggtcttgctgggaactgcagaccagagctgtttttattcagccaacttgaccaggaacttatctgtaaaatctcttacttttaaaaagaaaaatcacttgatctctgttttagttcatcttttgttggttataaaagaatacttgaaactgggtgatttataaagggaaagaaggaggctgcaaagtccaaggtctagaggctgcacctgctaagagtcttcttgttggtggggactgtctgcagagtcctgaggcagcatggggcatcgcatggtgaacgggctaagtgtgctagctcaggtctttcttcttcttcttatgaagccatcagttccattcccacaataacccattaatccattaatccatgggtaaattaattgattaatgaagacagggccctcaagacccaatcacctcttaaaggccccacctctcaatactgccacattgggaattaagtttcaacatgagttttggaggagacaaacatttaaaccatagcaactctatatttttcttccagcttccatccccatttgttcatcctcccttacaaatacctctaattcacattctctcacttcttgaacccacttggccaggttttcacccaagcactccaaagcttctcttaccaagtcgccaatgacctcttcattgctaaccccaatgttcaattctctgacctcatcctacttggtcaccagtttcttttctttgatatagtagcctccccttatcagaggaggatatgtcccaagacccccactggatacatgaaacctcaaatggtactgaaccctctctatattttgtttcttaaatttgataactgagatggctactaagtgactaatgggtgggtagcatctacagcgtggataccctagacaatgggattattcacattctgggtgggacagagagcgacagcacaaaatttcatcatgccacttggaatggcagcactcaacttaaactcatgaattgtttatttcaggaattttccatttaacattttcagactgtggttgactgtggttgaccgtgggtaattgaaactgtggaaaaggagggactactgtgctttcttcatctggcttcccattctccagtcttcttccttcctcagtagctgcacctcccaggctcccttgctggtttctccttgttttcctcatgcttcaatgctatgaatcccaggacttaggcctttgagttcttccctgctacattcattcctgggtgattttattccatcccatggctttacacattatctacactctcgtgtctgaacttgtatttctagtctgaattccagactcatacccaacttcctactcagcatctccatttcaatgttcaagttaaccatcttaaacccaaaattgaactcctctcttttctacttgaaacccactcctcctgaagtcttccccttttccattaagtgcaattccattcttctagttacacaggacaaaaaatctcagtgtcaccctcgatttctctctttttatccttccctcaccaaacccatcagcaaatgtcgttagctctaccttcaagatacgtccagcatttgatcacttctcactgcctctgctgccaccacctgggccaggccaccactgttacccacctgattcatggcaccagtgcctgaacatgtgggtcactctgctcacacacttgaccctacagcctgtctcaacacttccactgtctctaacatgagtcacagtgaacatgagtcagactttgtcagtatttctttgggtattatcaacattaattactatattactttcatgcctgcagacaccatgaggtaaagtgttgtgttttgaccctacacttactgaccccagacaaatatatttttctatgttcttatggttcttccgatgcttactgccactgactgtgttaccaatgtaatcagcagggctgcatcctacgctgtgcatttgtgcactacccagagatgcatggctgagtggggatcagagcccatgttccacactccaagccatgagtcctggtggacactgcatctgtccacccagaaaagatggcacctttctttttgcacaaaatgccttttgcttaacacgtcctacacctacaggtctgtctacacttgtgtctgtggggggttgcctgttctatttggtctgctcagtgcagggagccttttaaaatctgcttaaaggcactaaataggtcagtagcaggcactgtgcacactgtgcacttactttagttactttaggtaacttacttacctaaataaagcaagttaggtttccaggctcataaagaaattagaagaagcaaatgcagtctatattgtcccatgtagactgcattcgctgcttctaatttctttatgagccaggaaacctaacttgcctgatttctgtatatgaccaaagtaagcagactttaatgcagagtctcaagaagttgctgtatgactaagtgcctggaatttagagcattgatcttctggcatctatttggccgttcaaaagttctcttggttttggatctcggttctgttctggacatctaagtaagatacttctggattaacggaagtttatgggattaaaatcatacccaaatatagtttgccagaaagtgctttattaatctctcaagattaatactatatgcattttttttcaggatagtcacattagagcaatcctttctataaagactatttgaactttacactaaaaatgtgcttgaaatcattttaatctacttgtcacagtctcttcatgtctgcagttttgttctagcatgggctcagatagtgatccattcctattaccttactaactatcatactatcctacaagacaagagaaaggtcatctgctcccacttcctgatggagaaaattggaaacagataaatgcataggtaacttgtaaaatattggagcatgtagtgagacagtagcacataaaatattttgagataggtttatagaaactaaaacttaacattgaccattcagtgagtcagtaagatcctcagaaagatatttatttcccaggactgatgaggttaaagatagagaagagcaactcatagcacattacaaatacttaatatttttttaagatggtaaaaaacagctctttaaatttctgtaacccaactcttagacttcaataatttcattaagaggccccttactaatattttttaaacaagctattcaactccagaagattcatcctgtgatccacatttgcaagaaactggactgagatggtggtacggtattctaagcaatgttttattaaaaataaataaccaaaagcaagtattggggctgccgagagaaggaagcatcattcggtagtggcatgtggcagagatgccaatccaaggtgattatgcaatgagcataactgccaataacacttacttggggcttgtctcccagggaaacggagatagagttggattaatttttagcccagtttatgattctgcaccagggaggcatgtggtgttatttcccagggcatttaaattcttcctcctaaagcacaacactatcttgtcctgttctatttattttcctcaagtgtgtgtgacttgcagagcattaacacgccaaaacatatgtttcctaagcctgttctcccatctcaccttcacttagactttcaaggtcagagctatttgtggctatccacttaattggacttaaaataaaaggcagcagaaaatagtagatttgtaatggcccttcatagtaagcatcaaaagagcagcctggctgctcatctgaatgctatttaaataaatctgcctcttattataagtcagggccacaaaactccatccaccatgccaccagttactgtgtagctgacacaagctagaaacgagagcgaggatgtttcctgagccccctggaaaccactggagctttgaaccaattgtgcatttttgtataaagcatgatcatgtggttaagttctctttgccctcggaatgtgcacattaatcagctttgtgcaattactgtccatgctagacaaggacagagtagatcattactgctattgttattttttaccgtatatatggagcttcatacaattacaaagtgctgttcaagatggatgcaaatgttcctagggcatggaatgggaggagttacatatattgggggatagaaggtggatgggcaagtttggtccataaccaagatgtataaagctaagggcccagtacagacagcaaaacaggcaaagttcacatcttggagcaaaggcctgtggcctaactgctttgctggtagggcttctgggcaagaagtagggaagattttatgacgagaaagtcttttagataaggcagagaagaatcaggagcaggcaaagaaggatgatgcagcaaccagatgacaggcatcctgggtccaatgttcaagtagctttgcattcccaggttctctataatcaggaagtcctgggccccaaacaacccctgaatcctcctccaattcttagcttcaggggaacaatcttttccaaggacgagctcaaaggaagaaacagctttagggttgatccaagggtctcaaatcactctagataaaaatgtgcttagaaaacaagatagaacagcttggtaggggttcccaggctaggagctgctgtatctatggagcacatttcttaaaagctcacagaatggaggaaaatatttgcaaaccatatatctgataaggggcttgtaaccagaatagataaggaactctgaaactcaataataaggcaaatagcccaatttaaaaatggacaaaggacttgagtagacacttctccaaagaagctatacaaatggccaataagtccaacgttatcattaatcaggaaaatgcaaaccaaaatcatgaggtatcactttataatcacaaagatgggtataataaaaaagctaataacaaatgtcggcaaagatgtggagaaatcggaactctcatacacacaggaaagcaaaatggtccaggggctttggaaaacagttggcagttcctcaaaatattaaacatagagaacacatgacccagcaattctactcataagcatatgccaaagagaactaaaaacatgtattcacacaaacacttgtaagtaaatttcacttcagcattattcctaatacccaaaatgtgaaaacaatctaaattcattcaccaactgatgaaatgtggtgtacctatatagtgcaatattatttggacataaaaaggttacaacatggacgaaccttaaaaacattacgctaaatgaaagcagccagtgcaaaaagccacatattatataaattcatttatgtgaaatgtccacaataggcaaatctatactgacaaagtagattagtggctactgggggctgggcagagggaggaattgggagagactatcagtgtgtacagggtttctttttggtgattaaaatgttctaaaattagatagtgatgatggttgtgtgactctgaatgtatatgctaaaaaacactgaattatacaactagggtgaattctatggtaaatgaattacatctcagaaaagctgttattaaaaagtcaatagagaaacattatataaggctagaaggcaaagagaactattttgggccacagctggaataaactggcttttagaattgaaatgccttacctaccctgatgcccacacttgcaacctgaggggacaggagggtttctaatgattcctctttcataagtaggaaattagtcatttgctgcttgagtttaatacataaaacactacattttatgactgattcaggctcagactttttatcatgaacactcatcatcaccactatcaacttcttgaagcattaagcgccctttggccttctacctatgacaccaagctaggcaccagatactgcaaatgggaccagttagttactaagtcaaggggagtgattcaatccaagacagaaaacacagatgctggcaaaccaacatcagtcacaggtatgactagataggtgcatgaatagctaagattaaatattgatgatacacacaagagtgaacacatttatagggtggcaagaagagggctcaagagaatttcatggttgagcaaggtttagtttcagagatagggaactatttctctcttaatcctctgcaagaataaaaggaaagcaaggtcaagtccaaacactgaggatttgactgttagttagggattggttggggaactgcagattcatatggctgcaagggagacatcaagagagaggtctaggaaatgaaacctaggaagtaggcaaggccctgaaatggcaataggaaaacactctgcagggaaagataggactgaagaagagtaggcttgtagcacagagaagggactcagagcaaaagagaccaggagaagtgtatctttggtgggttggggaggaggagggcagaaactggattctgctaaacacttttcctgtttaatctcatcaaaaattcataccctccctatgaggaaaatgctattactttaaaaatttatggataagtaaacacaagcccagagaggttaagtaatgtatccaagatcacacagctaggaaggtctatccaaaataatctctgtcctaggcctaaataataatttcattgtgttaacctttagccatcatcggccgtctcggaaaactaacaggttcctggaatacaccaatattcaatgtctattacgggcctgaaataagtggttcaatatatatttggttgctatcaggtggtacggaaaaagaaaaccacctcagcctatgtaagttgctagaacaacagatgacagtttataagtgggaaaaacggtgcttcaggttttagctgaaggtgaaacctgtatttctacctacaccctgcttgtctaactcagtgtccatcaagcagtaaaagagaaagttacttacagagaagcagaaactcatctggccctttccaagaaggtcctgtagatgggtaaagaagccctcattactcctccaaaggaagcgatcctctttaattgggtttcttaattggaaaggcactctgaaggaaataagttcagcgattcatgacctaactatctcttctgttggccaacccataagtacaagcaagtatacttgtttctttcccattaacagagaaacacagagttatcagagctggcagtatcttggagataaactagtcctttcattttcaaagagaagacgcttggggcaaagtgcctggcccagggttacgcagccagtgtctgggatgaaagggacttctttccaggcttagtcctgctgatgcaaaattgtgactgcaccctttaaaactgtgaacactacattaaatatggcctggcgcccagatcctttccaaacccaccagtttttacccatacaagaaccatgtctgcatcatttggtttacaaatccaatccttcataaaaaggaaacccacctaatctaaatgcagcttcttgtctagattctgcttttctctgatttcataacctctctgcttcacccacatttcttttccacctgatgacaagctcactgggaaccaagaatgactggaggctcagcaagcatatcatgctgtgatctatgccttttttactctgcaatcgttctatctcagagccagagagcaatacatggtttggtgagtgttggcctcaggattctacagaaatctgcattggtcagagttagccaaatggacatagatggtgtgtgtgcttggagaggaagcattgatgatgtgtggatctaggtctaaatggctgaaagagtcccagtcatgaagattagcatggatttatatgtatttaatggtccttttagatcatggctctgaaatgctaaataaattaattactaaaaggaaaagctgagggtaagaagcaaggccaccaccaggccaaaagacacctttgcggaattaagaaaaggcaccccttcctctaggcagccacagtcccacatcagtgcattccgctcattcagtagagtgatgtctagcttccttctcctattcttcaccttgatcaaacagatgcccttgtagagtacacaactagtacagctttgcagggcagccctgctgaaagaaaggaagaaggagaaaaaaacgttcttaacataactaaggccacagccctttggtggtccatgaaattattttagaaagttgacaccagtatttttaatagaatgaaaaatttacaaaatataaaagtgccttatgcttagattttatctttatatggatatgtaaatatgcacatatgtatgtgtgcatgcatgtgcacatacatattgggttgagagtaaaatatatttacatggggcatggtcaaaaacatttgaaagtcactgatttgacagctcacaatgtgaaaagtgaatctaatttggaggcctgcttcatctgtatttttaagtgcccagtgagaagcactcaggtacaagagaactagcttgcagtttgaaatcagacaggctcaagttcaaacgccatttaaatatcactaaatttgaaccttaggcaatcatttatgtttcccaatcctcagattcctgatctgcagatggaggtgataatatttatttcagagtgttgatgtagtaagtacctggtattaagcactgcctacttttcaaatccctctcttctcttgactttggagagacctatagagaccagcagtccagggacacacatgcagctgcccaggatagttttccttgtcagaagccacaaatgctgaggcggtctagcgtcctacagtaaactttatatgactttttcccatgcacgttgttcttccatctgtctggaagagctacctcccacagcatgcttaagctaaaattattgcttggtcaagtcaattaaatcatttgagaaaaactactacatgtaagtcagttaagaaaaagagttgggtgatatgggcatggctagactctggtcttctgtttagggtgaatgtattagattgctgctttggcctggttagaatattccacgttgtaaatattacagctcctaaggatagaaatgaccagctaaaaatctgttaggtcactgagggtgaatctcccacattccagatgtggcaatagggttccttggaggtacagaatcccccttaggttaaatggccaaggagcacatcccagtccctgaaaacttcatttcccaaatcttcggtcatgaggactcctcttcagaataattctcccattaaaacaaaaacaaaaacaaaacctgcaaaaactgcctggctccatttaggtgtggaaatggggagagagaggagagctaaagttagtgattctcagcatatatttgtaagagatctttgtgtgagtcatcacagctagctttaaaattgacacaaaggacacaggaaactggcaatctataaaagaaaaatgtcattcttcataaacatatgtttcaaagcccagactcccaaataaagcaatgcacatttaaaacaattaattaaaatgctacgtttcatctatgaaattggaaaacattaaaaattataatattcaacactactaagtatgtagcaatgtggcagaaactttaaaaagctgataagccttgacccagaaattctgcttctacgaaatcagaaattcatgtgtaaagctatttgttgtagtattttttataatgttaaatattgcaataaatggcaacatgaaaatggctttctatattatgataatactaaacagtaaatagcattttagaaaaacatttaatgatggggaaaaggctccataataggccaaaaatttgtaaaaaccttaaaattgtatatattcaatatggtaaatataaaattttgtatgtccaatatgttcctatttatttaaatacataggtgtgtatatatatgtctatgtacatatgcatgtgtatatgtatgtgtatatgagaagttcagaagaatgctatatgcgaaaatgtgcatagtcatctttggatggtgcaatgagagaatataaactgttcaaaattttcttttttatattttgatgtgtttttaatactcttgtacaatgaatacataattttggtatctgataaatatattatttaaaaggcaaacctaaaatttaaagtggcctcatataacttcatgttagaattgctcctcagatttgaatgactaaaacttgctgtttctaggatttattattttgatgagaaactttactatgatggtcaggctgtattaaacattgagagaatgccattaaaattccataacagtgtcacttgttgtatgcattatcttttgagaaatctatagtctgaaatttctggcaatagaataacaaacccttcttaatatattactccctaaaatgttggaatattacacttgaaatatatttttcaaatatctaactattttatttagtgaggaataagggattcttagaacccagaacactgaccaaatacaagtccagaaatgtctgtattgctttgccttcaaggtatttgccattccttagcagcctaaagactaggtttttagaaatacaaacatgaggcctgatagcgggaagggagttcagagaacttctctatctgtaagctgagactcctgaagggttgacactttcagtaagcaaataagaaaaaaaaaatctgcctcgcaaagggagatggtaggatgtgtctatttgagtcttggtttttagtgctgctgaaagttgaagatggggaagaaagatgaatctcccttaagaatttttaagcacaggctcgctcatacgggtttgcagtctgaatttacactacctgggtagtaaaaaagtcaaacatgtagcttagaatggccccagttggtagtactcccggacctttgacaggagagcaatcctctctggaggaatgtacttaaaacccaggcctcaatggagttccacaggtaaagtcccaagaaacatatgctcaaagtttaaaaaaatttcatggttaagaatcaataaaacaacaaaactagacccacaaagatattgccacaaaatttatcaacaatgaaatacaaaataaatatacttaacatgtttagaggaataaaagaggcattaaaagtatgatgaaattagaaacaatgaaaagctacctaacagatttgaaaaagagccacataagacttgtagaaatgaataatataactaaaattagaaagtcaatagatgcgctttagagcagattagacaaaattaaagagaaaatgagacgctagaaggtagatataaagaaatgacaagaatgaggatcacagatagaaaaccatgaacagtgaaaacacgtggaaggtaagatagtacaagatacgtctaactggaattctagaaggcagactataggaagattggggtagaggcaaaattgttgggaggcactaatcctcaaaatcaggaagcctaatgagtcacaaatagaggatacctaaatgagaaaatcacacctgacatatcttaaggaaaatgccaaacactcaaagcaaaaaccttaaaagtagtaaaggaaaaaagataaatttcttataaaggagcaatgtttacatggatggtagtctttcaacagcaaaaacggaattgagagacagtggaatattattatcgaaattggacgagaaaataattttctactcactacttttgtcctatatttcaagaacaaaagtgaaataaaactctaagtaaataaaaatcaggtgcatctactattaacagattaagaaacatcatgaatgtacatcaggaatagagggaaaaaactgtagataaaaggtttggtatacaagaaggaatgaggaggggaaaaaccagtacatatgtggataaatctaaaaatattgatggtaaaatgacaatgtctaatttatgaggcttaaaaaatgaaagttataactcaataaagctgtttacaaaacatcaaggtaggcgggcgcggtggctcacgcctgtaatccgagcattttgggaggccgaggtgggaggatcatgaggtcaggagatggagaccaccctggctaacatggtgaaaccccgtctctagtaaaaaaagtacagaaaaattagctggatgtcgtggcgggcgcctgtagtgccgctacttgggaggctgaggcaggagaatggcgtgaacccgggaggtggagcttgcaagtgagccgagatcgcaccactgcactccagccagggcgacagagcgagactccgtctcaaaacaaaaatcaaaaaccaaaaacaaacaaacggacaaaaaacacatcaaggtagagcttaaattctagacttcgaattatatacaatgggtgaagtggtgactgagtaattttctaaggtacttaggttgtttagctggagcgtaaacatcttaattaactttatagtatgttaagttaaatacacaggttaaaattgctttttctttttcttttttttttgagatggagtctcactctgtcgcccaggctgcagtgcagtggcacgatcttggctcactgcaatctctgaagcccgggttcaagcaattcttctgcctcagcctcctgagtagctgggattacaggcgcctgccactgcgcccagctaatttttgtatctttagtagagacggggtttcaccatcttggccaggctggttttgaactcctgaccttgtgatgcacctgcctcggcctcccaaagtgctgggattacaggtgtgagccaccgcgcccggccacacaggttaaaatttctaaggcaagcatcaagataatagaaatagagtgtaggctcacgcctgtaatcccagcactttgggagctgaggcaggtggatcacgaggtcaggagattgacaccacggtgaaaccccgtctcttctaaaaatacaaaaaattagccgggcgcggtggcaggcacctgtagtctcagctactcaggaggctgaggcaggagaatggcgtgaacccgggaggcggagcctgcagcgagccgagatcgcgccaccgctctccagcctgggcgacaaagcgagactccgtctcaaaaaaaaaaaaaaaaaaaaagagtgtatacattccaaactattaaagggaaaaagagagttagaaaaaaaattcaaaaaaaggcaagaaaaaattctaaaaagaaacagaaaggccaaaataaatagaaagtatacaataacatgatgaaaaagaatccaaatgttacagtaatcatagtaaatataaacaaagtaaactttccggttaaaagacaatgcttgtgaaactgaattaaataaactgcatgcatattctggttactagagacttacctaaaacaaaagaaggttgaaaataaaaggatggaaaaactaaacttgccaaaaccacactctggatgtacttgtgtccccagtagcaagagaatagcttaacacacgatcccattctttgctaaagttaagatacaaattatctagttctaacaaaaaagaggggaaggggacaaaaggagggaagaggagaggaaaagaaggacaaagagaggaatagatgaagtaggggaaggtggaagggagagataatggtgactccagttctctaggattcacaaagtttaggtcatctgttgccaggggaaaccagaatagcaagggaaatggccaagggcaatttgaactgtgtgtatcaaaatccactgggcccttctgggtctctcaaaatgcctagttcactctctgaatcacaagcagtaactgacgggtttacttttaggataagtagagggaaacaaaataaggaaaatatcaccatgctgtatccctagataaacacactactttcacagtcagttaagaattttaatgcctaagtttttttcttttaagaaatacagagaattagtttccaaatctatcaagtaatacatctttttatttaatataaggaccatcttacctactttgaagtttgtatattaattttactaattaataaattctgtgtcttaagcaaagttgaggcaacacatgtatacttatacaattatttatggtttagtactttacaagaactacttcactttatgaagaatgtttataataattttgttttaatcctgattttccaaagaacattaatcacaatttgaattgctaaaaccctttacagcttttcagaaacacacaaactgaataaagcaaagcacacctaaattactaagtagtctggccctccaactatccagctttaagcatctttatttagattgtgcccttcattagaaccaggccaacttgctgtcagattacagtgccaagtctaagacgaagttaaataccatggacagctgctttctaggccaatgacagcctagcaccataacagatcaacggcccccagcagccaggctaggagcatagcaaaatgagccgaatgatctgaaacttaactgcttcacatcctgcaggattcaaacttattcctaaccagctatacagacattttaagaagagagccccaaacatctataaataaaaataccccaaaagcaaaagtctctgcttagaatggatattgctaagtcccagccaatgagctactcactttaagcaaaattccaaataataaaatctcaggatgaaataaagacattttgaagtttccttggagttaatgtttgacccatttatattcactgtatgtgaactagagcttatgaatattataatacagcaaatattatataaccctaaggggtatgacggactgcttaactcaaggattcactggagcaagttcagtcttcaaggaatgttttataactcttgaatctaaaataatttattccaactcatttttcacttaagaatgaaacataaaaggaaggcattaacattcattgaaaacaacccacattttccaaggatcatgctagatgcttaacattcatttcttcatttaataattttaccaatcttatgaagtaggtatcattattctcattttccaattaggaaactgaggcttagagagttaaaatgacttctctgaaatcactgggcttattacacaaccaggctaaagactctttcctttttgagttaaagccccagggtctcttcactgtgtcatgatggtatataactttttaaaaagggtagtagcatcactaaaagaaataacaataataaaaataagaaccacacacaaggtagagaaatttaaatgagatgagaaactgttgctttaactatgaaaaataatgccagttcatgtttttccatgcttcacagttaccctatgatgtacatcatcaacaatggaaccaaattaagattttatatttgcctatgaagcaagtagtttcaaggatattcactgcctagagcccagcagagttgacttttttgcaagaaccatttgatgatttgtataagaatatctaaaatgtgattcctctaccttcccaaactcccatgtcccataattttgcaaacaggacaatgaagtgactttgcatgaaaacatgcttagtattttgcttcctaaattcttgtacagcacattcctctctaggaagactccactgaaggccgcatttggcttaaagtctttttttcctagatgttttggtgatgtcagaagcattaatttctgtaagaaaggtaagctacacagtcagaattcaactctgcagccaggtgactagatgaccacactccaggattcatccccatttcaggatgaatcaaattacattaaaatcacattcagagatgtgattatgttcagtgcctgggggggaaaacctccctaagtttctgcaatcaggcatatgataaaggctgtaattacagaaaaaattccagcaataattcaaaagtgaaattggcaagtggtatttcctaaaggaaatcacacatccttatgcacgttccacttaaaaacgtgtgactgtgctctggcatttttttgagaagtacaaaataagacatagctttgtttagaaaaaaatctctacttccattagttaaccaatgtcaaaagaaacattaatgactaactggaataaattaaagctatttggtgctaaatggaaaacaatacaatgaacacattttggggggaaatcagaaacagaaatagttatgaatataacctgctttctttttcaatcaagtaaatctagaattcccaaattttagaacacacaatattaagtatagcacaaaattatggatgcaaataacaagggttaagggatgacaacctgaatttctgaccttaaaataatcataaaaatgacataagtcacctaattgagtaggtaaagatcattccagggctactttaatgaatggtttataattgactaaatacagtctataaacctatatttggaaagctatttctaaaacgcatgaaagcatcttccactccactaaaccatcttccaccccactaaaatcagaatacaaaatccttccgcaatcctacatataccattggattgctctgcagattcatttttcataaatgttgccaatataacattcagccaagtctctaagttaatgaagttccactagggtgtaagaaaacaagaaagtactgagttctcaaagagacttttcagcattgatgcacccaagaaatttataagacatcgaatcatttccttgcctctaaaaaataagcatttccttgacaatcgttcagtactttaattggaataaacacaagactatcaatgtacaccacccaaacggactcgaggagagcacttgagggatcacctttttggctgctaagttagagtaggggagaacttccaatgatggtcctattttatgccctgaaggagatgtactcagttgtcacatctgaatgcttgtttgccgtatattttgctaaatgattttttggttttactatagtttctaacaaacaagcatacgagagaaatgttagaaaatatgtagtacaagtagaaatattgctagtgttttatcctgccctttgcttccatttcatggctgcaatgaaaaggacggtcatcaaacttggctataaaagaattatgcaaatttaaccatattaatatcatttttcttttctttttgaacaaaatctttcaccccctgctcaaatatctgttttttgcatatatgagaattttcccagatgctggcatgaaaagtctatgtaggtattttggctttctgtttaaaatcacattcagagatgatattccactgctaggatataaatcagaactccattacaataccacatacgattgtattgatgccatttgtccactatttaaaaaaataatttaggtgtttgcaggaattacttctaagctctttaccaatctgctttccactcacctaagtggtaggatggccacgattgttattaaaactccctcaaattctactctaaaaatagttgaagtcatgtttattatggtgtgcaaagtgggtcattgtgatgcagaggcagatggcagggctggccaatgattctctttacaatggatgctgatcagttcctggtcaagtgacctaagacatgattgtgtcaatcaagaaaaacagccatgacaacaataatgacaagccctgctgggctaggctgctgactggaaggtacagctacggtgacacaaactttcttcctcagacatctctaaagagatggttctttcttggtaattgccatgtgttcatttaaaaagaaaaggccttgcaactttctaggcacatacacactttcctatgaaaattaaattgttcacaaaatcattatgcccactttcagaaaataagagacaaataactgctgaattggctttgggaggcttatgtaacctatatttacaagtgttttactctgaagcaagtagctgaggaacttagtaaacatctgcaagaataccccaaaattattttttccactgctatgttagtctagctatcacagaactgcagaatcaatctgctatccacaagagccccaaacaccatcacatcaaaagaactgcagatctcaaaaacataataattcagaaccgtagtcaagaaaagcattaaataaaaatccaccaccaccaacctttgcttgggcttctggtgctgtcaccttgacgaccttattgcggtttatcatttgcttcacccatttttctacttggacgttgaatttcatgaaaaccacatagcaaaaataagctgttaagagaagcaagctttcccaccacatgatgacattatccaggaaaaatatgatcagcatgatcaagtcaacaatgtagaaagacacatctcgaaagagcggccaccatgtcaggtttaagatttctctagaaaacagagcacacatgccaataacaaagaggatgttgaatactgctgaacctacaattgtgcctatgccaacgttgctgtgagcgataaatacccctatgagagatgtgaaaagttctggggctgaccctcctgcagccatgaaggtggctccagccacatcatcagagatgcccagtttttcagtgatgacagtcaaagaaggaacaaagaactcatcacagacaatggctaaggctatgaacatgtagatcattccaatgacatgcagaatgatcgcaccttttcttctctcctcaagggaaaagatgtctttcgggtagtctccttgggcgtgatctgtactattctcagactcgccttccttagaaagaggtggctgtggagtataatccagaatcttgtcatttaaatctaagagagttctctgatggtaaccctgtgctaccctagggccacttacaacactggcctctcctgtgctctgtgtatctgtctcagaaaaggcactgattgaaaatgagacagtgctaatggctaccagacccatgaaaaggcctaagactcgaattaacttcagttttttcttgacactataatgtcttctgcagccagacagtgactcatccaaacaccatttctctagggaagtgatggtggtgctttgttgcagatccatcctgggtcttctggtggatatggtgatcttccaactttagactcaaccagatggttctttcatacttttccttactttatagttaacgatgcttgtggggtactttcacaatcagggattgttatgcttcacaggaaactttcatcatttatg

SEQ ID NO: 1105 - DNA, 279569 bp, Homo sapiens; identical to SEQ ID NO: 1104

SEQ ID NO: 1106 - DNA, 16508 bp, Homo sapiens
tttaattagaaaaattatttatttctgctcctttcatacatcttattgttcaggaaacagtcttacatacatatctgaaataatctaccgtcacacactctagttaaaggcaaagcaccataggtaaacctgatcagctgtccagagttctcagcttatggaatcttgcttcttgattttacgttaatttctgaaaacagaaacgccatctccaaaaggtgttaagggggttgtaaaaaataatcactttatttgatattatagctgtaaatatggagcttttttttttaagaaatgaaaaactaagaagaaaatgccactcaacatcgttggtacagcaatgggtcagcaggggaaaaaaaaatactgtgataaacttgtctctttaataccaagaaggaattctagtccaagcttcaatacacttcctgttttttcactcggtatttcttttactgctgctcttcattcttttccacatttcatattagaggattggacagcctttaaacttcattgacaggagcaaatccagtatccattgagttcttctcaaaggcactctaacccatcagatagcccttctcaaaggcactctaacccatcagatagcccggcagtttcattctcatgaatactctagccatgaaaaagctcaataggacacaaacgaatccaatgaatagaagaagaaatctattgagttttgggatatttggtgcattccatcggtccaggaatatgaaacctaaacctcctattgtaaacaggaagctggatgcaagtccttccataatacattgttcatttactctgtaggccaagaaagctactggcctctgatgcccgtgttcatcagtcatagagccaatgcttggaggttcaacaataacatcataaattattcctccagtgacgaggaagtaagacaccaccatcagagcatacacaatcatggccgacagcacttgcagccagggcggcttcttcagcttcaggttgggacattcgagcactaagaatgggacacggtacaaagtctccatgttagtggcagcaagggtggctggtagtcatttaactatgcttacgttttagcagagttcaggcacctctcatcctcctaacctggtggttagttttacaagggtggttcgggtattatcatttaaaccataaactaaatttttcccaaagttagcttgacccaaacccaggaatgaccaaaggcagtttggaggttaaaggcatattatgggtgcgatggctcatgcctgtaatcccagcactttgggaggccgaggcaggcagatcacgaggtcaggagatcgagaccatcctggctaacacggtgaaaccccatctctactaaaaataaaaaaaaataaaaaattagccgggcatggtggcgggtacctgtagtcccagctactggggaggctgaggcaggagaatggcgtgaacccaggaggcggagcttgcagtgagctgagatcatgccactgcaccccagcctgggcgacagaccgagactgtatctcgaaaaaaaaaaaaaaaaggcaagatggagttggttagatcaacaggtctctttcactgtcataattttcttattgtttcaatcttagcaaaggcggtttcaacccaattaagataggaaagaaaaattgtcttgacattggatcttggacacaccctcgtcttagtgctttggcatttgctcctccccctgttgggacacgcttcccccggggtatttaatggctctccctcaattccttcagggatctgttaaatgcggcttcctcagaaagccttccttgttcaccccatttgaaacagtgctctcatcaactccaaccctttcttctgctccaacatcttcataacacttaattctacccaacattagagtacatagcaatttgttcatacatttatggtcgttttgcttgttagaacgtacactccacggacagccactttacctggtacactgaaggcactcagtaaatattagttgaatgaatgaatgattggatgagtgaatgaatggccatttggcttatcacgtaactctacatgtgattggctaaagagtcttgctgaggtccaggaaacagagacctagggaggaaaggctctcctgtcacctgcaggtcacctaggtcaccaggcagaggcataactgcctctactgctagaaggaatatcttttgttagctaattacatagcaagaaactccacttttggctgggtgcggtggctcatgcctgtaatcccagcactttgggaggccaaggtaagaggatcacttgagcccaggagttcaagaccatcctgggcaacacagtgagatcccatctctacgaaaaatacaaaaattagccaggtgtggtggtgcgtgcctgtagtctccactactcgggaggctgaggtgggaggatcagttgggcctggcaggtggaggctgcagtgagccaaaatcacaccactgcactccagcctgggtgacagagtgggaccctgtctcaaaaaaaaaaaaaaaaaaaaacaaaaaacaaaactctactttctggaaatcacgaatgcagatactttataatagctatagctgtaaatattttcaaaacctaattggggcttatggattaaaaagtatattagctgaaaacattttgactcaacacaattatacccagtggcattagaagagaagcacttaatgatacattatgcttgtggctaacaaagcatttgcactaaatgggtaacattttcatttcctatttcaatttccacatcgtttgtagagagcttcattacatacaccccaaacctaagtgaaagattgagcctgtaaattaggattctgacttccccatttactccaaactcttaaatggcttattttctatttctacaaaagccagagatcaagaattcacgcaaaagtcaggggatttaggaaatattaattcatctcccttagggagcccagtgccaaaagaccaaccacaaatttaaaaaataattatacattgcagggaggcagaggtgaacagaagacggagacaaggacaaagtcatgataagaagagaggaactgttttttacagaagctgacaacataaggaaacatgttagctccctttttctaaaaggtaaggaaggacaactatgaaattaattgttctgttagtggactatcaaggcaattaagtcttgatctattcggtatatttcctcttcaaatcataacacttattgaaatctggagagttggagtcatggtgtaagagtcttgtattttccgtgggctgtgtgaaggtgatagcattttgcacattccgctggtagcacgtatcttgctgcactgtaacgttgtttacatttatatgcaccgtgatggattatgaactcctgcgggtctgggcctctggactcataatcctctgtacaccagtacaacccattaaacatttcacagatcaactatgaagcagatgcacctttaccctacagttccttaaaactcattccatattcaattaatatccagaaggtctagaaaattcttagtccagcaatgaaatctggtagtttgtcaagagtcaactggtgttcagttgtttttaaaaaacagattagagttacttaaaaattttctatgggaagctgaggagggaggactacttgagcccaggaattcaaggctgcagtaagctatgattgcaccactgcacaccagcctgggtgacagagcgagaccctgtctctaaaaaaaaaaattctctgaaagtgcaatgagagagtttgtagtgaatagaatgctaaataaatatttgagaaatatattcaaagtgtgataggagaaatttaattttcacagataaaataagcttctcaatgacaaataactttgcaaaaaatttgttgccacaatggcactcaaatgtgtattcactttcctgtattcactaatactttactgtttttcttttctgtttttgtttttcattgttgttgttgtttgtttgtttgtttggacagggtctccatctgtcgcccaggttggaatgcagcagcacaatctcagctcactgcagcctcgaccttctgggctcaagtgatcctccctccttagcctccccaagtagctgggactgcaggtatgcaccatcatgcctggctaacttttttgtatttttagtagagacagggtcttactctacttactctactccatgttgcccaagctggttttgaacgctcaagtgatccacccgcctcagcctcccatagtctgggactacaggtgtgagccagtacacctggccctgtttttcaaatactataactgcttccccagttggaaattctaaggatcagtattgacccattcactcgtttactcactgattcacttaaccaatatttatcgagttctcaccatgtgtctaagcactaaggatatatatatatatatatatatatatatataatttttttttttttgagacggagtctcactctgtcgccaggctggagtgcagtgccgtgatctctgatcactgcaacctctgcctcccgggttcaagcaattctcctgcctcagcctcccgagtagctgggactacaggtgagcaccaccacgcccagctaatttatgtacttttagtagagacggggtttcaccatgttggctagaatggtctcaatctcttgacctcatggtccgcccgcctcggtctcccatagtgctgggattacaggcgtgtaaggatattttagtgtatgaatatagacatgccattgtggagcttagagttatcaaaccaatacacaaatagtcgaaacatttcagctgtgataagaagatgtatttgctgcacctggtgctaaagttattataagggagatttgctttaagccgggtcctcaagggaagctccctagaagaaatgatgaataaactaagatctggagggttgtagatgaaccaggtcaacagagcggggaagagcgatgcaggcacaagagaagccaaagtttctggtgtgggaagcaaagccagtggggcagaggctggagaccgtgccagggcatagataggtgttacggaatttgacttatccttggaaaatgggaagtcactgaagtgctttaagccagagaggggatgggttgagctatggtaagatctgatttgccttgcccgaggcgctctgatcctgtgcagaggaaatattagggggcagttgaattggattaggagttaggtgacttggacaggaggcttgagggaggcctaacgtgccccaatcccgcaaacagtggctccttcttagcaaaagtcagtgttttgctgcaaaattaaaataaaagctgaaaatgtacttcccaacttataaggagatggaatgccagccacattgaacccaaatgattttttaaatgtaattgttccgccacaaagcctacaagcttcttaaaggcaggacatgtatattattattattgattgtgtcttcaggccaaacataccagataaagtgattaaatggttgtcaaatacatgaagaaagcatggtgtgtttgtttgctagggccaccgtgacaaagtaccacagaccaggtggctgaaacaatagaaatgtattttctcatcttctagcgggtagaagcctgggatctgctgggtgcagtggctcagacctataatcccagcactttgggaggccaaggagggaggatcacttgaggccaggagtttgagaccagctgggaaaacacagcaagaccctgtctctgttttttaaaaagaagaagtctgggatcgaggtgtggacagggctggctcctcttgcggtctgagggaaggatctgtcccaggcctctctgcccggtaaattgctgctttttcgttgtcttctcatcctcttcctctatgtatgcttctgggcccaaatttccccttttatgacaccggccgttttggattagagcccactctactgacctcattttaagcttcactgcctctgtatagaccctatcccaatccaaataaggtcacagtctgaagtatcgggtgttagggtttcgacataggaatttgaggagataaaatttagcacacacacccatgggctgtgcattttggtagctgggcagtgttagaagaagccctttaatgtggcagcctgtgctagtagccagtgggccccgtcgtgggccaggcatgagcagagttggtggtgggtagggcagggcagagagcatgcctttacctggtctcttcaaagcccatctcattttctttctttccttttttttttcagatggagtttcgctctgttgcccaggctggagtgcaatggtacgatctcggctcactgcaacctctgcttctcaggttcaagcagttctcctgcctcagcctcctgagtagctgggattacaggcatgcaccaccacacctggctaattttgtatttttagtagagacagggtttcgccatgttggccaggctggtcttgaactcctgacctcaggtgatccgccggcctcagcctcccaaaatgctgggattacaggcgtgagccactgcgcctggccccatctcattttcttgaaaaggcccaagtaaagtagatagattttccaaactgttagaggttgaattgtgtttcccaccgaaaaaaaaaaaaatcctctgttgaaatcctaacttccccagtacctaggaatgtgactgtatgtggaaatagagtctttaaacaggtaattaaattaaaattaggtcattagttgtgctgtaatccaatatggctcatgtgtttacaagaggaaatctggacagacaggtgcaggcatgtgaagacacaggcagaagacggtcatctgcaagccgaggtgagagacctcaaaagaaaccaaccttgccgacactttaatctcagacttctatttgacaggatgatgagaacatagatttctgttgtttcagccacccagtctgtggaattgtgttatggcagcctgagtaaactaacacacaatccaacctggctagcactcctactctcaaagcccaggtttcactcaataattccaaaccatggttcacttctttttttaaaattagtattattattttttgagatggagtctcactctgtcgcccaggctggagtgcaggggagcaatctcagctcactgcaacctctgccgcccaggtccaagcaattctcctgcctcagcctcccgagtagttgggattacaggcgccagccaccacgcccagctaatttttgtagtttttagtagagatgggatttcaccatcttggctaggctggtcttgaactcctgacctcgtgatctgcccgccttggcctcccaaagtgctgtgattacaggtgtgagccaccgcgctcggccatttcacttcttattaatcacgaccagtgtttcctgagcacttaccacatgtcagacatggtactaagaatgttatcagtgttatttacttaacctgtacaaatagagatagggactattatgaacttaatttttatagaaaagaaacctgagagtaagagacatgaagaaacttgcctgaggtcatccagaaggaagaataaggagtcaaggtgtctccaaggcaatgcccttccaccccgagcacctctgtgctggcctgagaacatgttccaggaggcagagcctcacttcatggtggggtctggggcacagccaacacatctgggggcttagattatgaagaagtgaaggtatcccttaaagcaactttcctagtttcttggattggcttatgactctagtttcttcttaattcttgcagaaatcataacccctctattaacagtattaagactatgccatgctggccaggcacggtggctcacacctgtaatcctagcactttgggaggccgaggcaggcagatcatgaggtcaggagatcgagaccatcctggctaacacggtgaaagcccgtctctactaaacatacaaaaaaaaaattagctgggcgtggtggcgggcgcctgtagtcccagctactcgggaggctgaggcaggagaatggcatgaacctaggaggcggagcttgcagtgagccgagatcgcgccactgcactccagcctgggcaacagagcaagactccatctcaaaaacaaaaacaaacaacaacaacaacaaactgatcttaagtagaggaaaagaagattgaagattggaagaaaatgacagatcatcaaatcacaaagaaatgggggaatgtggaatctgtccttgatgactgccactgaatattcacactaacatcacagtgaggtccctgttcatttgtgcaggagaacatgtacaaacatttaggcagaacatacgcagagtagagtatacagacctctccctcctgttcaggcttttagctggcattaggggtttgagaccttggaatgttgtcaaagaaaaacacactttaaaagcccgtttccaaaagggtgacaaacgggactggatgatgtgtttaacctcatgaaatattgaactcttggatgtaaatctgcccatatcactagagatgaaagagttattcctgtttttatgtctaattgtggaactggtgaaatttgcatttccctagaatcactgcccctgttgatagttgaaacacacagttttgaagaacagcaaatcatactctaagaggcagtagtcccctatgtcctgtcgttttccctgtttctgccttctatagacacccttgccaccactcagaaatgtttgagactttgtggagaaagtagactggtgagaatttcctcgtacttggaagggttaagcactgagtcgatctacagcaagtggcacacccagtttgaggtccacgagggtgaagtaatttatctgtgagtcatatcactgaatacactgttctatagaatgttggttagcaactcacttccaaacatcgtggccaatggttctgttagacataacatttgaaagtgagatgagttgctcatgtgggcttagcaataggcaatgaaacgaatctggcattgaaacagacgtgggtttttacaatgggtttagactgaaaagaagtgctgtgttgcatgagtccatcttcacactaagcatgaaagccagagaaggaccatccggtgctcctggtggagacagtgtctcgggacactgcctgtgaggttttcaggataggaaaaagaagagaaaaggaaacccagccccttggttttcttgttttataatgtggccatttcagaggctgtgactataggattaaatgcttagcaattggcaggactttatattgactggtgtttaaaacttaaaattcagttattccaaccacagatactattaaaagaactctggagtcaagaggaatgagcaggcaagagggtgaggctgtgtctatggctggaggaaaggtgtgatgagttgctgttttgttgctaggcaataggttttatgtgacaacaattcctttcctttaaagaactagagtgctctttttgtttaatgaaagcattagattttcttggtacaagaggtacccattgagtttacgtgaatatgtggtattatagtaaacagtgcttatgaaagggaatgctattctatttttgaattcttttgttttacattgccacctctagaaatcatttgcctgaggagatgtggttttttccttttctcaaatgatttctgttgtttggcttgtctgactgtaaacctctaaattacccccagctgttatgaatgtgcttctgaatttctcaacagatagcatagcatgtttgtgtttggggatgttagaagatttgcttttataattccaaactagttaacaaatcctgatgtaaatatgttatggtatcttctatatttcttcttttattgatcctattataatgtaaaatgttgtagactgcttatggtcacattaagacagggccatatatctcttgcatccttatagccttaataccaatctaacataaaacttggcatatagtttatatcaataaatgaacggttgttgaataagtgaatgaatggatgcacaaatcattgatatactgttgcattttccagtgacgtggatttatttatttatttatttatttattattttgtttttgagatggagtctcgctcagtctcccaggctggagggtagtagtacgatctcagcttacagcaacctctgcctcccctgcctctccggttcaagcgattctcctgcctcagcctcctgagtagctggtattacaggcatctgccaccatgccctgctaatttttgtatttttagtagaagatgaggtttcaccatgttggccaggctgatgtaaaactcctgacctcaagtgattcacctgcctcggcctccccaagtgctgggattacaggcgtgagccactgcgcctggcctgataatattcttctatattttagagaccatggagttaattctaaaaatggaaaatacttaggcctgaataccagcccataggtttactatttttccctaaggtaatgtcttctccttaagcagcattagagctttgctaacatgccatctaaaaatgtaccccccaagctgggctcagtggctcacgcctgtaatcccagcactttgggaggccgaggcaggcagatcacctgaggttgggagtttgaaaccagcctgaccaacatggagaaaccccgtctctactaaaaatacaaaattagctgggcatggtggcgcatgcctgtaattccagctactcgggaggctgaggcaggagaattgtttgaacccgggaggcagaggttgtggtgagctgagatcgcgccattgcactccagcctgggcaacaagagcaaaactccgtctcaaacaaacaaacaaacaaacaaacaaaaaaatgtatccccccaagaacaggaagaagtgtcatggaggtcttttattttcaacaatatagaaacatttttggatgaactttgtctctcaggttttggagaattaaaatgcctcccttatcccatccctgccacactctaggacattgattcatgttcccaaagaataatggttagcttactgtatgccagctactattcttagctccttacatgaactaatccttttaatcctcacaactacactatgaagcggatgctactattgtccactttatgggggaagaaactgaggcacagagaggttagcttgcctcgggactctgtctctgctgagattggaagcagaagactagttccagaattcacactcctaaccctactacaacacctgctctcaaacagagaagggaaaggaagtcctggcgtttgcactctccttgatcttgtgctggtctggtctggacatggaccaaggcttgggggccttgcacacgtaagtgagtgcagatgcccggcccagccccagggctcccttgtccttgagctggggccacgctgaggctgaggctggcctccatggcttgacttgaggccacctccagatccacaccctgaaagcttgggactggccttctcagagaatggggcaaaacactctgacgccaactacaaccatcacaaggaggtacattctctgtaagggcaagcctggggctgcacccaagtagactagcagacactcattacagagagaatgttctggcactctggccctgccaaaggctaccagaacacagaaggccctttcttccaaggggccgaaggaggagcaggcacacaccatatgcctcactcaccacacgaaaccacacaccacatagcacacacgcgtgcaccctcataccacactgacccttcaccacacacacacccatacaccttcatgtcacacataccacacacacagatataccacatgcaccccatacaccccaccacacacatacaaacaccacaccatatacacacacacacagtacaacatacacactcacacaccatatgccacacacatatactttacacatatacatacctccaaacacacaccatgcacacacacggtacaccatacacacaccacacactatgcacacaccatgtaccacacacatacccctccaacatcacatgaacactacgcaccctcccccataccacacacatacacgcacacgtaccatgcacgcacacacaccacaatgtgctgttacttaacaggtttgccttcccacaactctatcagcaaacccttctggaggcgcagcccacacctgcattccaaagaacgcaaatcccttccctgcccgatgaaaggcccctcccacagtgagtcacagaaactgcagccgagcaggcagtggtgggccccacccttctcacaggaagtgagaaagagtaaatatgtagtttttctttgagggccaatgcacatgttaaatgggtgattaagaagacagagagctgcttaaaaggtcatgggagaagtacaatgtctggggacttggcagtagcctggcagagaccgcaggaatcctatagagtcttttatggacagggctctgaaattccagagcctgcaggaggtaccttcccctttgactcggcggggctgtaccactaagaatgcactgagcattgggtgcacttgggatacctgagctgtggggccagagaggcagccctaggggagaattccggagttggggctgggttctttcagcataaaaaatcaaagtgtcgcttctttaatgaacctcccggcaaggtcttccctgaagaccttgaacaagtgttcttaaacaagtgttcctttatgcaattaaaggccagggaagctggggtctgagaggccatggagccattgggataatagtgacagttcggctaccattcaactgggcttctgatgaatcatgctgggggcaaggactccaaatcaccagctctactctatactcgaatcagtaggcagttcagacagtcttgggggatttgggcaaacgaacgctccacttagaatctctccagaaagacaaagggggtgcctaacaaacaattcaaggactgtgggaaaccaatgatcatcaagggctcagttgtacagtgtaaaccaaaaagtatctgagacaggtctcaatcaactgagaagtttattttgccaaggttaaggacaggccagggaggaagaaacacggaatcacagaaacagtctatggtctgtgtcgttcttccaagatgatgttgagggcctcgatgtttaaaagggaaaagtgggctggagaggaaagaggaagggcatgggaatctacttgttgcaagggaaaaggagcaggaagaggaacaatcagttacgtttcctctagcagtctgtaaattggtgctttacataagatgagcatagagtttagctgcctgtggtggggatatctagccttttatctgtagctatctgcttaggcacaaacagaaaggcagcttcttgcatgactcagcttctagtttaattttttcctgttgccaagaaaaaactggggtcctgagagtttttcttttcctttcacaacaggaagaaacaaactacagagcccctaggtatactggggccacctggggtcttgttaaaaatgtgcatttgggggaggggcggagagtctgcgttccccccatgcagtgcccaggctgctgctctgtaggccacactttgaatactgagagtaccagagaggacttggtggtagggggtggtgggtggattctggtacagttggagggaggaggcttcctggggtgagggcactgagatgggtcctggtggtaagattgtgtggggaggagaataaaggtaccccagatcaaccttgtggggcaacaagtgacctgacaaactcccatcatgtatggccactgtcccccattcaaggccagggaccgttggaggagttggaaagttaagagcttgaaaactggattctgcctcactgggaggttcactgacatttagtcttctctgaaagatgggcatagttataccaatcctacaggagtagtgtgaagattaaatgagatgacatataaagtgcttagggcctggggcagcataagtggtagaatatttgttcatattattattgttattattattagctgaagcaatttttttttttttgagatggagttttgctcttcttgcccaagctggagtgcagtggcacgatcttggctcactgcaacctctgcctcccaggttcaagcaattctcctgtctcagcctcccaagtagctgggattacaggtatgcgccaccatgcctggctaattttttgtatttagtagagacggggtttcaccacgttaggcaggtctggaactcctgacctcaggtgatccacctgcttcagcctcccaaagtgctgggattacaggcctgcaccaccgcgcccggccctcctgttgacttcttttttttctttttttgagacggcgtctcactctgttgcccagactggagtgcagtggcacgatctcagctcactgcaacctctgccttctgggctaaagcaattctcctgcctcaacctcccgaacagctggtattacaggcatgtgccaccacgcccagctaattttttttatttttagtagagacggggtttcaccatgttggccaggctgctcttgaactcctgatctcaggtgatccacccgcctcggcctcccagagtgctgggattacaggcctgaaccaccatgcccggccttcctgtttacttctgagccctgggccaacatacttcagaacagaaggcccctggtggctggaggggctctcttctccctcttcatggccctgaaggggcggggcagtggtgacactgagagggacaggagaattggacctgccttgacaagacggcagcaaggcctcattccctggggcctagaagaaggtgactgcgctgggcatacacaggggagaggattcagagtattcaagacgaatatattgggtagaaaaagttatttaaaatatttgaaacaagtctcatttttacactgaaatgtcacagtccttcaggctctctgttttagccaaaggacatcaggacatggtcttacccgagatatagccagattcagtataggtacttcttagtgttaggtgttctaatgcctgtgtcctgccccagccctccatgagagccaagagctgtgctgaatagaattgctgagcccttgcagaagagggtgtcatattttccaaatattccctttgcaagataaactagccagaaggtaggaggtgtcaggcagcgccgagcaccggctgggccagacctctggaagagcaactgggaatgttgattacagggcaagaatctaaacagcagtgatttattttccaaagttgctggcactttttaatccctttttctctcttcctcttccctttaacagggcagagcaaacaatcttcaggccaatgcaatgctttgtgggttttttgcattgatttgtacatgaaaccatgttttttttttttttttgagatggagtcttgctctgtcgcccaagctggagtgcagtggcacgatttcagctcactgcaacatccacctcccgggttcaagcgattctcttgcctcagcctcctgagtagttgggattacaggtatccaccaccatgtctggctaattcttgtatttttaatagagatgagatttcaccatgttggccaggctggtctcgaactcctggcctcaggtgatcctcctgtcttggcctcccaaagtgttcggattacagatgtaagcctctgctcctggcctgaaaccatgaattttttatgtggccattattattttataaatgctgctttctttctctatctgttcttttcagtacttagccagcgtgcagagaagcttcccagttaggaggtgaagaaacacaaggctgcactggatgcggaggctcccacctggaatcccagcactttgggaggccaaggctggaggattgcttgagcccaggagttcaaaaccagcctgggcaacatagtgagaacctgtctctacaaaaaataaaaattacctgggtgtgatggtgcacgcctgtagtctcagctacctgaaggacagaggtgggagaatggcttgagaccaggagattgaggctgcagtgagtagagatcacgctactgcattccagcctgggagacagagcaagaccttgtcacaaaacaaaacaaaacaaaacaaaacaaaacaaaacaaaacaaaaaaaacacaaggccacccttcctcacgatgccgcaggtcccctccccttctctcagcatggctggagagcccctcaactgtggcctgctgtccttgatccagtgccccacgctgccccacccttctggggagcccacctcaaagagaactccctggaggctcctacagtggcctccggctgaccaaagtgt

SEQ ID NO: 1107 - DNA, 683650 bp, Homo sapiens
  misc_feature (268290)..(368289): n is a, c, g, or t
cactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttacca
